US011274334B2

(12) United States Patent
Chenchik et al.

(10) Patent No.: US 11,274,334 B2
(45) Date of Patent: Mar. 15, 2022

(54) MULTIPLEX PREPARATION OF BARCODED GENE SPECIFIC DNA FRAGMENTS

(71) Applicant: Cellecta, Inc., Mountain View, CA (US)

(72) Inventors: Alex Chenchik, Redwood City, CA (US); Costa Frangou, Sunnyvale, CA (US); Mikhail Makhanov, San Francisco, CA (US); Russell Paul Darst, IV, San Bruno, CA (US); Donato Tedesco, Mountain View, CA (US); Lester Kobzik, Mountain View, CA (US)

(73) Assignee: Cellecta, Inc., Mountain View, CA (US)

( * ) Notice: Subject to any disclaimer, the term of this patent is extended or adjusted under 35 U.S.C. 154(b) by 103 days.

(21) Appl. No.: 16/543,211

(22) Filed: Aug. 16, 2019

(65) Prior Publication Data

US 2020/0063190 A1 Feb. 27, 2020

Related U.S. Application Data

(60) Provisional application No. 62/765,124, filed on Aug. 17, 2018, provisional application No. 62/799,448, filed on Jan. 31, 2019.

(51) Int. Cl.
*C12Q 1/68* (2018.01)
*C12Q 1/6806* (2018.01)
*C12Q 1/686* (2018.01)

(52) U.S. Cl.
CPC ......... *C12Q 1/6806* (2013.01); *C12Q 1/686* (2013.01)

(58) Field of Classification Search
None
See application file for complete search history.

(56) References Cited

U.S. PATENT DOCUMENTS

| | | | |
|---|---|---|---|
| 5,994,076 A | 11/1999 | Chenchik et al. | |
| 2003/0082758 A1 | 5/2003 | Rosen et al. | |
| 2003/0186246 A1 | 10/2003 | Willey et al. | |
| 2006/0121452 A1 | 6/2006 | Dhallan | |
| 2008/0050393 A1 | 2/2008 | Tang et al. | |
| 2013/0123120 A1 | 5/2013 | Zimmermann et al. | |
| 2013/0244897 A1 | 9/2013 | Lueking et al. | |
| 2013/0274117 A1 | 10/2013 | Church et al. | |
| 2015/0038343 A1 | 2/2015 | Leamon et al. | |
| 2016/0251714 A1* | 9/2016 | Conant | C12Q 1/6874 506/4 |
| 2016/0376664 A1* | 12/2016 | Chenchik | C12Q 2535/122 506/4 |

FOREIGN PATENT DOCUMENTS

| | | | |
|---|---|---|---|
| CN | 107385042 A | 11/2017 | |
| WO | WO2004051218 A2 | 6/2004 | |
| WO | WO2008069906 A2 | 6/2008 | |
| WO | WO2011014811 A1 | 2/2011 | |
| WO | WO2013081864 A1 | 6/2013 | |
| WO | WO2013128281 A1 | 9/2013 | |
| WO | WO2013138510 A1 | 9/2013 | |
| WO | WO2016172126 A2 | 10/2016 | |
| WO | WO2017210469 A2 | 12/2017 | |

OTHER PUBLICATIONS

Zheng et al., Anchored Multiplex PCR for Targeted Next-Generation Sequencing, Nature Medicine, 2014, vol. 20, No. 12, p. 1479-1486.
Giardina et al., Whole genome amplification and real-time PCR in forensic casework, BMC Genomics, Biomed Central, 2009, vol. 10, No. 1, p. 159.
Lin et al., Multiplex genotype determination at a large number of gene loci, Proc Natl Acad Sci USA, 1996, vol. 93, No. 6, p. 2582-2587.
Langmann et al., Real-time reverse transcription-PCR expression profiling of the complete human ATP-binding cassette transporter superfamily in various tissues, Clin Chem, 2003, vol. 49, No. 2, p. 230-238.
Myllykangas et al., Chapter 2 Overview of Sequencing Technology Platforms, Bioinformatics for High Throughput Sequencing, 2012, p. 11-25.
Clarke et al., Modular tagging of amplicons using a single PCR for high-throughput sequencing, Molecular Ecology Resources, 2014, vol. 14, p. 117-121.
Parkinson et al., Preparation of high-quality next-generation sequencing libraries from pictogram quantities of target DNA, Genome Research, 2012, vol. 22, p. 125-133.
Head et al., Library construction for next-generation sequencing: Overviews and challenges, BioTechniques, 2014, vol. 56, No. 2, p. 61-77.
Blomquist et al., Targeted RNA-Sequencing with Competitive Multiplex-PCR Amplicon Libraries, PLOS One, 2013, vol. 8, No. 11, e79120, 14 pages.
Markoulatos et al., Multiplex polymerase chain reaction: a practical approach, Journal of Clinical Laboratory Analysis, 2002, vol. 16, p. 47-51.
Shen et al., MPprimer: a program for reliable multiplex PCR primer design, BMC Bioinformatics, 2010, vol. 11, p. 143.

(Continued)

*Primary Examiner* — Suryaprabha Chunduru
(74) *Attorney, Agent, or Firm* — Mandar A. Joshi; Bret E. Field; Bozicevic, Field & Francis LLP

(57) ABSTRACT

Methods of preparing a plurality of sample-barcoded anchor-domain-flanked gene specific deoxyribonucleic acid (DNA) fragments from a template nucleic acid, e.g., ribonucleic acid (RNA), sample are provided. Aspects of the methods include employing a set of gene specific primer pairs, wherein each pair of gene specific primers is made up of a forward primer and a reverse primer, at least one of which includes a sample barcode domain. The methods find use in a variety of different applications, including high-throughput sequencing, e.g., expression profiling, applications, including of small biological samples, e.g., single-cells.

12 Claims, 87 Drawing Sheets

Specification includes a Sequence Listing.

(56) References Cited

OTHER PUBLICATIONS

Zhao et al., Comparison of RNA-Seq and Microarray in Transcriptome Profiling of Activated T Cells, PLOS One, 2014, vol. 9, No. 1, e78644, 13 pages.
CoPrimers by Co-Disgnotics Inc., downloaded in Apr. 2015, 1 page.
Karn, High-Throughput Gene Expression and Mutation Profiling: Current Methods and Future Perspectives, Breast Care, 2013, vol. 8, p. 401-406.
SureSelectXT RNA Target Enrichment for Illumina Multiplexed Sequencing: Strand-Specific RNA Library Prep and Target Enrichment Protocols, Agilent Technologies, Version F0, Apr. 2018, 67 pages.
SMARTer® Target RNA Capture for Illumina® User Manual, Clontech Laboratories, Inc., 23 pages.
Gaublomme et al., Nuclei multiplexing with barcoded antibodies for single-nucleus genomics, Nature Communications, 2019, vol. 10, p. 1-26.
Mamanova et al., Target-enrichment strategies for next-generation sequencing, Nature Methods, 2010, vol. 7, No. 2, p. 111-118.
SeqCap RNA Enrichment System User's Guide, Version 1.1, Roche Sequencing Solutions, Inc., 2017, 51 pages.
Samorodnitsky et al., Evaluation of Hybridization Capture Versus Amplicon-Based Methods for Whole-Exome Sequencing, Human Mutation, 2015, vol. 36, No. 9, p. 903-914.
Stoeckius et al., Cell "hashing" with barcoded antibodies enables multiplexing and doublet detection for single cell genomics, Genome Biology, 2018, vol. 19, p. 1-16.
Xu et al., Detection of splice isoforms and rare intermediates using multiplexed primer extension sequencing, Nat Methods, 2019, vol. 16, No. 1, p. 55-58.

* cited by examiner

FIG. 7

TABLE 1

| Col 1 | Col 2 | Col 3 | Col 4 |
|---|---|---|---|
| | GGCAGCAACTCGGG | CTGGAAGAACCCGC | AGCTGTGCGCAAGA |
| GCCCAGGAAGCCGA | CCGCCTACAGAGGG | CACGCGACGATACC | GGCGGAACCTCATG |
| CCACGGCCAACGCC | GGAGATAGGCGCCC | GGCGATCAGGGCAG | GAGTAGGGTGAGGC |
| GCCAAGGGACCAGC | CAAGTGGCCGGCGG | TACACGAGAACCGA | ACCGTGACGGCAGT |
| GACCGCAGCCGAGG | GCGACGAGGCCACT | GACACCTCCCCAAA | CCCACAGCAAAATT |
| ACCACAGAACCCAA | AGCGAGACGGTGCC | AGCGCGTCGAACAG | ACCGAAATCCTCAC |
| CGACAGGGGGAGAG | TCGGCAGAACGCCG | AATCCCCCGCCCAA | AGACCAAGGGAGTT |
| GGAAGAGCACCGGG | CCGAACCGGGTGAA | CAGCAACGAAACGT | TAAAGGCCGAATGG |
| GCCCGAAGCACGGA | GACCAATACACGCC | ACCCGCAAAGGTGG | CACCCGTTGGAAA |
| GACAGCCGACCAAC | AGGAGCCGGTAAAA | GCATAAACGGACCA | GTAGCCCCACAAAT |
| GAGGCAAGGGGCCC | CAGTAGCCCGAGAA | ATCCAGAGCCAACC | TGAGGGCGTAACAC |
| ACGAGCAGCAGAGG | CGCACACATCACGC | CAACCGGTCACGGG | AGGGACGCTGCGTG |
| CCCCAGCGCAGACA | GCTCAGCGCCAAAG | GGAGGCCAGCCTAG | ACCAACTGACGCTC |
| AGACAAAGCCGAAG | GAGAAACAAGATGC | CAGAACTAGCACGA | GCAATCACGCGTAA |
| CACCGAGGGGAACG | CCAAATAACAAAAG | AGACCCGCAATCAG | TCTCCGGACGCACC |
| CAAGCGCGACACGA | AACAGCGACACGGT | ACCCCCTCGACCGC | CGGGTCGCCTGAAA |
| CACCCGAAAGCCAG | ACCAAGACGACCAT | AACCGTCCGCAGCG | GAAAAAGTAGGATG |
| GCGAGCGAGACGAG | GCAAGACCCTCACC | AGAGCACGTAAGGG | GAGGCGGTCATAAA |
| AGAGGAGCAAGGGA | ACCATCACCAAGCC | AGACGGGCACATGC | GTGGTAGCGCGCGA |
| GACGGTCCCGACAC | CGAGACCCTCCAGA | GATAAGGAGCCCC | AATTCCACACAAGA |
| ATACGAACGACGGC | GCTCCAGGCAGCCA | CACAGCTGGAACCA | CAACGGCGTGGAGT |
| AGCTCGGCCAAGAA | AGCTGAGGACCAAG | GAAAGACAACGAGT | ACGGGTCATGGGAC |
| ACGAGAGTAGCCGA | CCACCCTGGACACG | CGAGGAAAAGGTTA | GGACCTGGACACGT |
| ATGAGCGGAAAGAA | CCAGGAAACACCTA | AACCCAAGTGTAAA | GAAAAATACGGTCG |
| GGCAAAAACCCATC | CAGGAATCCGGCCA | GCAAACTCCGGGAT | CGCAGGACATTCCC |
| AGGGGAGACCCGTC | GTGGCCGAGGCAGG | GCCACTTGGGCCAG | GTTACCGCAGGGCG |
| AGCAAGGGCCTGCG | CAAGGCAGCGGTGC | AGGCCCACAGCGTT | GACAAGCCCGTTGA |
| GCCGCAAAGTGGGA | AAGCCGCACACTCC | TGCTACGGCACACA | TGCGTGGCGACGAC |
| GCCCAAAGTCGAAC | AGCCAGGCAACTAC | CTCTCAAAGAAAGA | ATCAGAACATAAGA |
| CAAGGTCGCCGGGA | CTCCAAGCCCCGGA | GCACCCCTCACAGT | ACAAGCCGCATGTC |
| AATGACGGCAAGCC | CGTGAACCCCACCC | ATCCAGGCAGAGTG | TAGAGGCGGGCCTC |
| GAGCCACGAGTCAC | GTACAAGCCGGCCA | CAGGATAAAGACTG | CATAGAAGCCGTAA |
| GAGGCGCAATACAC | ACAGACGAACACTC | CTCCAACTCGGGGG | CCGTAGGACAAGTG |
| TAGGGAACCACACC | CAAACAAAGCGATG | TATGGGAGCCAACG | TGAGACGCGAGCAT |
| GGGGAATGACCAGA | AAGCGGTGACAGGC | TCCACGCGCTGCAC | CCACACAAATCTAG |
| ATGAAGAAACAAGG | TAGCACGCCGACAG | TCTAAGCGCGCGAG | ACGCCGTCCAGCTG |
| AACACGAGCGGTAG | GTACCCCAGCGGAC | GGGGAACTAGGTG | AGAGGGACCTTCAC |
| GGGGACGACTACGA | CACAGGCGGTGGGC | AGGCGCAGAATAAT | CTAGGCATAGCCAG |
| GGAGACAAGGGGCT | CACAGGAGACACTC | ATCACCAAGTCCGG | GAGCACGTCCATCC |
| CCTGCAAAGGAACG | AAGCACCATGCGGA | CACAGTACGAAGAT | ACAAATTCAGCGAC |
| GCGAATGGAAAGCA | GCACTACCAGGCAA | GCGCAACCGTTAAC | AGAACATGGGTCCG |
| CGGGCTCGGACACA | GGCGAGGGAGGTCA | CCCCATACCCACGT | CGCGATGCCGCACT |
| GGAGCGACGTAAAC | GGTACAAACAACCG | GGTTAGAAGCCCCG | GCGGAGTGTAACAA |

FIG. 7 (Cont.)

| | | | |
|---|---|---|---|
| CTTACACCGGAAGC | GGCACTGCTGACAA | CGCCCATGCCGTAG | GAAGCTGTAGGGCG |
| AATGGAGAAGCCTA | CTAACCACACTCAA | CTGCACCACTGGGA | CCGGACTCGACCTA |
| GAGCGACACGCTAT | CGCTGCATGGGACC | CAGCGGGTCGATCA | CCTCCGACGGTGAG |
| ATGGTCAAAAACGA | GAGCATACGCATAG | AGGGCACACCTTCG | AAGGACAACAATAT |
| CCGGACGTGTAAAC | AAGACCTAAAGACT | GAGTGGGCAGCGGT | GAGCAGAGTCGCGT |
| ATGCGACAAATAGC | GGCCAAATCCACTG | AACAACTCCGTGGC | TGACCGCAGCACCT |
| CGTTCGAGGAGCAC | AATTGGAACGCGCC | TGTAAAGCCCCCGC | GGCGACCGACCTAT |
| CGTCGGAACAACAT | CGCGAGCTACCGGT | GCACACGTAAAGTG | TCAGGCCAGACAGT |
| TGCATCGGCCACCG | ATCGCAGGGCGTGC | AACGGCCTCCTCGC | AGAATCCGCAGTGA |
| TTCGCACACCAAGC | AGGGACCTTCAACA | CTCCGCTACGCGAA | GACAGAATGGCAAT |
| GATGACCCGAAGAT | AGAGACCTCGGCTG | ACTGAACCACTGGA | ACTGAACTGAGGAC |
| GCTTGGGAGAGGGC | CCCGACCCGTTCAG | AGACGGTCCGGTAG | AGAAAGGGACGTAT |
| AACACCTGGATGGG | ACTTCACCGCAAAG | AGGGTAGTGAGCGG | CATCCGCAGCGTAA |
| CCACTCGCTCCGCA | ATGAAAAACTGGCC | GGAGCGCTGCATCC | CCTAGTGACGGCCG |
| ATCAAGCGGTGAAG | CGCGTACGCTAACG | TTACCCAGGCAAAA | ATAGCCATAGAGCA |
| AGCAGGCGAAGTTA | GCTCCGCTCAGGA | GTCAGAGATACCGC | AGCCGTGAACGTCG |
| CGAGGGTCGAGTCG | AGTCGACCTGAGCA | AGCGGAGGTACGGT | AACAGAAATCAGTC |
| ACCCAAAAACTTCG | AAACGAAGCGGCTT | CTCCGAGCTAGGAC | TACAAGGCTAGCA |
| AGGCTGGAGGATAG | CGCAACTAGGATAC | CCAAAGATAGATCA | CGATGCGACCAACT |
| TGATCCAGAGGCCA | CGTATGGAAAACAG | GGGCGAAAGGTACT | AGGCCGACTCATAC |
| AAGACCACTTCCCA | CGCAGTCGGTCCAG | GTTGCAGGGAACCC | CTGCGGCACCGTGG |
| AGATGTAGCGGAGG | AAGCGTCGTACGGG | GTCTGGCAGCAGAA | AAATAAATCGGGAT |
| GAAACGCACCTGCT | GCCGGTGCGTAAAC | TCGGAGAACGTGAG | ATATGGTGAGCAAC |
| AGGGCAGTAGGACT | GGACTACACACGTG | CGGTGGAGCGCTCA | ATGCCAGAACATAT |
| GATCCTAACCAACC | CGTGAACGAAGTCA | GAGCGCCTTAGCAC | TCAAAGTAACATAA |
| CAGCGTCGCGAGTG | CATACCGGACACCT | TGGCCAGAGTCGCC | GGGCAAGCTCTGTG |
| GTACTAACACAGCA | CAGTAAGCCCAATG | GCAAGTCGGCGCTC | GAAGGGGCTTCCTC |
| AGAGGTGAACAAAT | CTCGAAGCCTACGG | CCCAATCGTAGGAA | CTAGAGGGAGCTTG |
| CCCCTAAGGGCCTG | GGAATGGCGTACCA | CGTGGGAACGGCT | AGAGAATTTAGGCG |
| TGCCGTCGCGAAAC | GGTCGAGGGACGTA | ACCACCGACTGGAT | CCGTAACCGCCCTT |
| CCACATCGCAACCT | ACGTGAGATAGCAC | CAACCAGCGATTAG | TATGTGCAGGGGAG |
| GCGGCTGCCTCACG | TGAGACATCCCGAG | GGCACCCTCTGAAC | AACGGTGGGTTCCA |
| CACTACAAGGGGAT | GTCCGCGATAAGCG | TAAAAGACGCGTA | ATAAATCCAATCAC |
| TAGACCCCCTGACC | GAACTGGCTCAAGG | ACCAGCCAGCTCAT | TAGCTGACTCGGGG |
| ACCGGGAACTTACC | CATAGGTAGGGCAC | GACAACGGGTGTGC | GATTGACGGGCTCC |
| TAGATAACCGGGCA | CAATGATGCGAAAC | CTAGCCCAATCCGA | ACTTATAAGGCAAC |
| CTGGGGAAGCAAT | GTGCCGTCCCAAG | CTATCCAAACGAGC | CTTGCTACACCCAC |
| CGGCTATGGCCCAG | ACGACACGCGTTGA | GAAGCGTACGCTCC | TACCTCAAAAATGA |
| TCTGCGAGGGGCGA | CTTCAGACAAACAC | ACGTTCGCAGGAAA | TGAAGTTCAGGCGA |
| CCCAGGGGCTTCGA | GAGAAGAAGCTTAC | GAATGACGATAAGG | TGAGCCCACTTACC |
| TGGGGACCTGCGAC | GGAGGTCTAAGCGG | GAAATAACGATCAG | ATTAAGCAATACCC |
| GCATTAGCAGAGCG | AAGCCCGACATGTA | CAATGCAACATGGC | GAAATCTTCCGCGA |
| TGAGACCACAGTCG | GAAGCGAGGTTCCA | CTACAACGGCTGCG | GAGGTAGAACAATT |

FIG. 7 (Cont.)

| | | | |
|---|---|---|---|
| CTCGGCGATCTCAA | ACCGATCGTATCGC | TCACAATATGACAC | GGGTACAGTCGGTG |
| CGGTATTGAGAGCG | CTATACGGCCTACC | CTATTGCGGGAGAA | CTGTAGGGCGTCAA |
| CCTTGGTCCCGAAG | GCTAACACGGCTTC | GAGATCCGCTGTAC | GTAAATCCCCTACC |
| TGATCGACCTCGGC | ACGTAGGAGCGTAT | AAATCGATGGCGCT | GACCATTGACGGTG |
| TGCGGGTGGTGACC | GGATGGGCTAGATC | TCACGAGATCCGTA | AATGGCGAGGTGTG |
| TCCACCTAGGGCTG | CCTAATGTGGCCCA | CTATGCCGGGCCAT | TACTGAATAACAGG |
| GCACCTGCTGGATA | GGTGAGTTACACAC | TAGTCCCTACGGAC | ATCATAGCTCCCAC |
| GCCCTGCCGCTTGA | AAGCTACCTCACCT | AGGATGAGTTGGCG | GCGTCCTTCCCCAC |
| GGGCATCTAGAATA | GCACATTCGATGAC | GCGGCTGTGAACCT | GCTACAACTGACTG |
| AGGTTGTGGGCGGG | CAATCGCTAATCGC | TTGAGCGAAGGTCA | GTGGAGGCTTCAGC |
| TACTCCCGTCAACA | GCGCTGGCTTCGGA | GTATCCCGGATAGA | CGATCTATCACCCC |
| TAAAGCTGAGTCAA | TGCGTCGGGTAACA | AACGCCATATCGCT | CCCGTCTAGGCGTA |
| GTACGCAAATTAGC | CTGGGAACAGTTCC | TCTATAACGGCAGA | GGCTGACCTAAGTC |
| GTAAGTGGGCTAGG | AGAGCTGCACTGGT | GCTCACTGACTACG | CGACTGGAAGTTCA |
| TATGGCGCAACGTA | GAACTAACTTGCCC | CGTCGCACAATTCG | AGCTCAAGTTCGAG |
| ACCAGACGTCTGTA | TGAGTACCCAGCCT | AGTAGAGTAATGCC | CGTTGCGGCTGACA |
| GGTAATACGCTACG | CTCGCTGACGGCTG | GTGCTCATAACAAA | GCCTACCGGTCCGT |
| ACTCCCTCGTAAC | CCAATATCCGCATG | GGGTTGCAAGAACT | GGCATACCCTTGGG |
| CACGTGGCTCCGCT | TAGAATGACAATGA | CCTGACATTCCCCA | GAAAACACTTGTCA |
| ACGGCGTACTATAC | TCAGCGTAGTAGGA | GGCAATTCCGATCA | GCTACGTACAGCTA |
| GCCAACGTATATCA | TACCGCGACTCCAT | GCACAGTATCTCGA | TACATGACATACAA |
| CTTAAACCCGTCAG | CTAGGTACTCGCCA | AGGGGCTATGTCGC | AAATGTTACCCCGA |
| CCTGTTGCGGAAGG | CCGTCGGTGTCGCG | GCGCTGGAAGTAGT | CCCCTGATGATGAA |
| ACATTGCGGTCCGC | GAAGACCTACGGTT | TCGTGTCGACGCCA | GACTCCATGCCC |
| GAGACACTGCTTCG | GAATGTCACTGAAA | CTACCATTGCCGGA | ACACCTTCCCGGGT |
| ACTATACCCGGTCA | ACAAACTAAATCCT | CACTGCAATCAAAT | GACGGCTGATATGA |
| GTCCACCTGTGACA | TGTGGTGGCGGCCA | AAGTCACCTTAGAG | GGGAGAGGATGATT |
| GCATCAGGCGGTTC | TATATCCGCAACCC | AAGGCATTATAACG | AGATAATGGAAAGT |
| ATCAAGGAGGCTTC | TCGCTATAAGGACA | ACCTAGACCGCTTC | ACCGTAAACGGTTG |
| GTGCCTTAAAGGCA | ATCCAGACGCGTTA | AGCGGACTAGTCGT | TTATAACAAAGGCA |
| TGGCCTCCACAGTG | CATATCCCACCATA | TGGACTCACGTCCC | GATGCTGACAGTCA |
| TGAGGAGGACTTCG | TCCGAGGCCCTTGA | ATAGTCCGCCTAGA | GCAACAATTCCTCA |
| GTCCCGAGCTCGTC | CAAGCTGGGGGTGT | CATTCACCCCGTCA | GACGTCATACCTAC |
| CAGCTATTCCGAGG | GTGAAATCAGTGAG | TTAGCACCGGTGCC | GACTGGTGAAAATG |
| TAAGATCCCAAGCT | GGGATTACATAACG | CCATGACCCTTCAA | CTCCATCGAATCAA |
| ACCCCATAGCTGCT | GATCCCTGCCGGTA | ATCAGTTCAACGCC | GGTCGGGGATCTCA |
| AGCTGCCTGTACCA | ACACTCCCATTGAA | CCACATATCGCGTA | ATACGCGAAGTGCT |
| TCAGACATTAAAAA | CTGGACCGGAGTTA | AAAGACTCAATTAG | ACCGGCTCGGTCCT |
| AGTAGAGGTGGTAG | CGACAGCTTATGGC | GTCCGGATTAAAAA | TAAATACGGTACAC |
| ATGTGCTACGCCCG | AGGTGGGTGCCTCC | TTACGCTCGGAAGG | TGGGACTGAGCTCC |
| CGCAGAAATATTCG | ACGACCGCCTTTAG | ATCGCCGTCACTAC | GTTCCAACGCCAAT |
| CGGTGCCTATAGGG | TGGGAGTACTGCCA | CGTGCCCTTAGCAA | CTAAGGTAATACCG |
| CCCCGTCTGACTCA | GCGTAGGATCCATG | CCAAATTCGGATGA | CCTCCTCGGAGGGT |

FIG. 7 (Cont.)

| | | | |
|---|---|---|---|
| GTAGCAGATGACGT | AATAGTGCGCTGAA | CCTACACCTAGAGT | ACGGTATCTATACG |
| AGGAAAGGCATCTT | GACAGGTATCAACT | CACGATTTGGAGAA | ATACTACTAAACTA |
| GAACAGCATTGTAA | GAATCACTTCAAGC | CCTCAGAGTAGTGG | CTACGGTGTACTAC |
| CCCGATCTAAATGC | CACTATAAACTGG | TATCGCAACAGATC | TGCTATAAAGGACT |
| CGGTGCCCAAGATT | ATGGAAACTACGCT | CAGCGCTGGGTTAA | AAGACTTTCATCGG |
| GAATCCGCAGTTCA | GCGTCGCATTGCGC | CGATCCGATGTCCA | CTTCCGGACCCTAT |
| GTAACAGCCTTGCA | CCTGGGTATAGCGA | CCATTCGATACAAA | TAAAATGCACTTCC |
| TATTAAAGCGAAGG | CGGACTGGGTAATG | ATCACAAATATGGA | AAGTCTTAGTCCGG |
| GAACTGAGTGAGTA | CCACCTGTACGGTC | CGAATAGCTTCCCG | AATTCTAGTACGCC |
| TCCAAGACTGACGT | GTGGCCATGGATAG | CGGAATTTGGGACA | GGCCGACGCGTTTT |
| CATAAGATTCGCAC | CCAAGTTACGAGAT | GAGGCTCGGTCTGG | TGGCATAGCGTGTC |
| AGGGCTGATGTGAA | CAAGGGTGAGGGTT | GGTATCGAGGCTAA | TATTGCCCCAGTAG |
| AGACCATACTAATG | CGCTAAGGACGTGT | CATGTAAACGTAG | TACAAGTCTCTGAG |
| GAACCGGACATCTT | AGTTATAAGAAGCA | ATGTACAGCAAATG | AAAACTGTACCTGT |
| AATACTGAGGTCCG | TGTGACAGACGCTA | CCACCGTGATATCT | TCCTACGGTGTCGG |
| ACGTTGGTCGAAGA | GGAGGGCATTGCTG | TCGAGAAGACTTTC | TGTAAGCTCAGCGT |
| GCTAGTGGACCGTA | CCCTGTGATAAAGG | CCCTGGTTACCAGT | CGTACGGTACCGTT |
| AGACGCCTATCGTG | CGCCTTAAAGCTAA | GCTTATCCCGAGAT | TGGAGGGTATAATG |
| GTCAGACAAGCTCT | CATAAGAGTATGCA | GGGAGTGGCTTCTG | ACGCAATTCTAAAT |
| GTTGCAAGTCCGCA | TGAAGCGAGAGATT | AAGGACGGTCTATT | ATTATGGGAGATCA |
| GCGAACCATATTGC | ACGAGCGTTCACAT | TTATCACGAGCGCT | TCAATGCTATAGGC |
| TTCATAGAGGCACG | GATGCCAAGTATCG | AGTAACGTTGATCA | CGTAGTTGAGTGGA |
| TTCACCGGGAGTAA | GGGCTGCCCCATGT | CCTTAGTATGCAAA | ACTTATACCAGCTA |
| GACTTGAATCGGAA | GCAACCTAACTAGT | CCAGTATGTGGGAT | GAATAGTAACGCTT |
| CTTGGGAGTGAGAC | CTGCCTCTCGGCCG | TTAGTAACAGACTC | ATTGGAACTGTCAC |
| GCCAGATAATGCAT | CGCGCAGTGTTCGG | GCAGGTTCACCGTT | AGTACTACAGATTG |
| ACTAAACCGTTCCC | CGACGGGGTTACTC | GTGCTCTACTGCAC | ACCCGCTATCCTCT |
| TCGCGCTGGCACTG | GTGAAACTTCGGCA | ACATATGCGCTCGT | TAAACTAATTGCGG |
| TACACGTACGTCCG | CTACTACCCTACCG | ATTGTAATGCCCCA | AATACTCCAATGGT |
| AGAGCCGGTTCAA | AACTAAGTATGGGA | ACACGCTGTAACTT | GTTCCAGCAGTTAC |
| CAAATACTGCTGGA | CCGGATGTGATGGG | GACACCATTGCTGT | TCGCATGTAAGATA |
| CTCGCGACAGTCGT | TAAAACAACCTGTG | GCAGTCTATGTAAC | TTTGCGAAGATACG |
| GAATCTACCGCTGC | CAAGAATATGTGCA | TTAGAGATGACGGT | GACCCGTGTTAAAT |
| CCAGGGGAAATTAT | CAACGTGGTCCCGT | TCTTAGACCAAACT | AGTGAGTGATTGGG |
| TCGTTAAGCGCACG | AGTGGAAAGCCTTG | ACGCGGTAATAATT | TGTGTCGCTCCACA |
| CAAGAGGCTCTAGT | CCCGATGTAGCGAT | TTCGCTACTAGGGC | ATGATCACATGGGT |
| CTAGTGAACTGAGG | CACCGCTCTATAAG | CGATTGCGGACTCT | GTACTGGGTGCAAT |
| CCCGAAGTTCACTC | CCCGAGTTGTCAAA | GATATAGCAACTGT | GACCACTTCTGCTC |
| TAACGAGTGGATAG | AACGCCCTTCCTCA | CCTAATGCCCGGTT | GTACGTCAATAGTG |
| CGACGTTTGCGAGA | ATATCCACGGATGA | AGAGGTCGGTTTAC | TGGCCCTCCGTTCC |
| AGTACTGAATCCCA | ACTAGATCATCGGA | TTACAAATCGCTGG | CTGGACAGTGTCTG |
| GAACGTCGGCTGAT | GTAGCGGCATGGTC | CTTATGATACCAAC | GGACAGTGTTCGTA |
| AGGGTGCGGCACTT | TTGGGCGAACACGT | GATGTCGTGGTCCA | TAGTGCCAGGGTTC |

FIG. 7 (Cont.)

| | | | |
|---|---|---|---|
| TTAGGGTCGCCGTC | GGTTGGTCCACGGT | ATCTTCCTGCCACA | TCGGGTGCTCCCTG |
| ATACAGTTCCAGTG | ATGGGCCTCAAATT | GACCTTGCTATCAG | TACATTGTGAACGG |
| ATGCCTGCTCAGTC | GATATCACCCTGAT | TCCACAATCTTAAA | TAGGTTCAACGTCA |
| CTTTAGCCATCACG | CGTGGTAACCTTCG | AGTGAGTTCCCATG | CCAATTGATGAATC |
| CTGAAAAATCTGAT | GCTTTATAGCGAGA | GTTCTTAGCGAGGC | GAAACTGGTTCTCG |
| ATGTAGGCCCTGGT | ATTCTACGTGAACG | TACCAGATGGGTGT | TGGTTGTCCGAAGC |
| TACCTTAAGTGGAA | ATGGACATGTGATG | GCATTCGGGTATAA | TGTGGCTCATCCGA |
| TTCGGACAGGTCCT | GTGGGGCTCTCCCT | CAGTACCCTTCATA | CAGAGCGTAGTTAT |
| GGTCTGTCGGCTCA | CCCGTCAGTGCTCT | GCAGCCATCCATTT | AATTTAGGCCCATC |
| CCCTCAGCAGTTCT | ATATCCAAAGCCTT | GGCCACTGTTTAAA | ATGAGGCGTACATT |
| CCGTGCACCGGTTT | TTGCTAGAAGCGTG | GCATCATGTAAAAT | TGTATAAACTGCAC |
| GTTATTCCGCGAAG | TAGCTTACAATCCG | TACGTGTGTACAGC | TACCTAGATCCTAC |
| ATTTAACGGAATAC | GGGTCATCCGTGCT | TATACTGCCGCATG | TCCAGCCATATGCT |
| CAGAGATTTCTGAG | AGTGTCACTATGGG | CATCATCGCTTACG | TATTAGCTCACGCG |
| CTCATGACTGAATC | TACGTAGTAGCCAT | CCCAATATACTTAC | TCGATTCGGTGCGG |
| GTGGCTGCCGGTTC | ATACCATGGTTAAC | TCTCAATTCGCGAA | CTAAATATGAGAGT |
| GTGCAGGAATTGTG | CTTCTCCGATCCAA | GATAATTCTGCGAA | GGGTGCTTTCGACA |
| CAAATGTACTCGTG | GGCCTTTTACCCCG | CGCTTGTAAGAGTC | AACAGATTTACATG |
| GTTAGGTAACGTCA | TGAAACTTCTCAAC | ATCGGGTTAAGATG | AAATAGCTACATCT |
| TCTAAGTGTAGCAC | TTAGAACTGGATAC | GGGCTCACGGATTT | AATCCCTGGGCTTA |
| TCAGTGACTACCAT | TGAACATTAGTAAC | TATGTCGCGAATAG | CCTAACAGCTCCTT |
| GTCTTCAACAGCTG | GAATGAATACCTGT | ACTGACTCCTGATG | TACAGATCTCGATA |
| ATAAAACTCTAGCT | AACTCAATGCCTTG | CTGTTTACAGGCGA | AGACATGTCTTAGA |
| CTGGGTGTTGGCGC | GTTGCGCAGTTGAG | GCCAATCTTCAGTC | TAATTCCCCTGGCG |
| GGCTCATAGTGAGT | GCGTCGATTGTACC | TCACGCGTAATTCC | GTGTAGATTCGACG |
| GTGCAGTTGTAGGG | TCGAAAAGTGTAT | ACTGGTTACCCAAT | CGTAGATATTCCGA |
| TCGCAAGACTTATG | GTCACGCGGTCCTT | TGCGTAGTTAAGGA | CTTACAATCGCCTG |
| CGCATTAGCAGTA | TTTAATCGAAAGAC | CGCCTCGATCTTGA | CGTACCTGGGTTGG |
| CTTCAGGGAATGGT | CTAGGCTGGATACT | TGGTCGTCCCGGTG | AATCCCTATAGTCC |
| AGCACATTTGGCTC | AGGAGTCAATGCTT | GTGGTTGTCCCGGC | CGTCCTTCAATCAA |
| ACCCGAGATTTTAC | TCTAGGGTTAGGCA | TACGGACCCGTATT | TCGGAGAGTCGTTG |
| GGTAGCAATGTATC | CTCCTCACAGGTGT | TGCCATCTGGATGG | GTGTGTTCAGAGGG |
| GGAATGTAGCTATC | TCTCATCCCACATC | CGGCTTCTCCCTGC | CGGTAACAATCTTC |
| GAGATTCTAACAAT | TAGTGAGGCGATTG | CGGTATGCTTAACA | GAGCTAGTAATGTA |
| CGCTCATCATATCG | CTAAGGGCTGCATT | GGGGAGGTTTTCAG | TGTGCTCGGTACAA |
| AAAAGTAGTTCGTC | AAAATCACTGTTAC | ACGGTGGTACTGCT | TGCTCTCACATAGG |
| ATGACAACTAATGT | GGTTTGGTAACGGA | AATCACATTGGGCT | CATAGCGTTTGCCA |
| AATTGAATCCTAAC | CAGTTATATAAGCG | TCGTACTCCGTCAC | ATACCACACTTCGT |
| TCTGGAAAGAGTCT | AGCATAATCATGCT | TTCCCGCTCGTAAA | GGACCGATTTATAG |
| ATGTACCGATAGTC | AGTCTCTAAGATCC | TCGCAAATTAATGC | ACATGTGTTCCCCG |
| ACTAGGCGTTCCGT | TGTAACTCCGGCTA | CACCGTTCCTTCGG | CTGGGTTCGTCCCA |
| GGTCGCACTTAATG | GACTCGTTAGCCAT | GGTCCTAGGTGACT | GCGGACCTCCTCTT |
| TCGTATAACGGCTC | GGTCGGTTGCCCTA | CAACATTCTTAAAG | TGCTCCTAACGATA |

FIG. 7 (Cont.)

| | | | |
|---|---|---|---|
| TCCGACAGGTGCTT | GTGGCAGTGATTAC | GCACTTAATTATCC | TCTAGACCAATTAT |
| ATGGAGTTCAGCTC | GTAGCCGTCATCGT | CATACGCATGTCTT | GGATCCCTTCTTAA |
| CGGCTTACTCAGAT | TAGATCGCTAACTG | CACTGTTTTGCAGA | TTGATCGGGCTGTC |
| CTGTCACTGCATAC | TCCCAACATATAGT | TTACCCGGATTCGT | GAGCCGTTGTTCCT |
| GGCGTTTCACTAAA | TCCTCGTACTGTGG | CTGGTGCTAATCAT | GGACTTCGCTGCTT |
| ACATTTACGCAGC | GTTGGTCAGGGTTA | TGCCTATCTCAGTC | TATCGTGATTGGGG |
| CATTCATAACATGA | GGTTGGACCTTTAA | TGACTAATCGTGTA | TTCCGGGTCGCTGT |
| AATATATGCGAATG | CCTCCTCCTGCTTA | CCGATATCATGTTC | GCGATCGGTTTGCT |
| CGTTAACCACATA | TTTCCGACTAGTAA | GTAGGAGTTCTCTG | CCCGCTTTCTCTGA |
| CGAACTAGTTGAAT | ACGAATTACGTATT | GATAGCCTTCATTA | GTACGCGTTCGTC |
| GATTAAGACGGTC | GAACATCGTATTTA | TGCTTAGCAAATAT | AATTCAGAATCTTC |
| ATTAGCGCACTCTG | GTCTCTTACAACTC | ACCTCTAATGTTCG | CCATCATGGCATTT |
| ACTTTGCCTAAAGA | TTCTAATCACGCTG | TCATACCGGACTTT | TGTAAACATCCTAT |
| TTGCTGCCTGCCCG | ATAATCAGTACTGT | GTGTATATCTAAAC | ACTTAAATGTACAT |
| CCACATTGTCATGG | GGGCTAAACTTTTC | TGAACCAGCTATTT | GTTAGTCCTACGGT |
| CCTATCCCGCTCCT | ATACACTGAGATTT | CGTTTTGGCCAGAT | CTGTAATGTATCGC |
| CGTATCGATTCGCA | TGTCTAAGTCGTGG | TTCTAATATGAGAA | CATCTCTTGGGCGT |
| CGTAAGTGTGAGTG | TTTAACTCACAGTC | GTCTACTCGGTTAG | ATGTGACCTATTGG |
| GTCCGATGACTCAT | ATGTCTTCAAGCAT | AATATTACAGTCCT | GAGAATCTCTTATA |
| TCGAACCCTTGTAC | TTCTTGCAAAGCTC | TAACAGAAGTTGTT | GGTCTTAGCACTTA |
| AACCTCTATACCGT | GTAGTATATAGGTC | TCATCGATACTTGG | AGTCTTGACGCTCT |
| CGTTGCAGCACGTT | AAATTTCTCTACGG | TTCCCGATTGCGAT | CCTATTTCTCCCAA |
| TCGTTCGTCGGGCG | GTCTCCGCTAGTCT | CTCTCGGGCTTTGC | TATGTATAAGCTAC |
| CGGTAAATTATGAG | TTTCATCCACGCGT | CTTCGGCTGGGATT | ACTACTGCTTCGTA |
| ACTGACGCGATTTA | GCTCGAATCTATCT | CCGAGGTTGTGATT | TCGTCAGTTTGGCA |
| CTGTAGATGCCCGT | CATGTTCCCGCTAT | CTTTGCAGTTGGGG | TAACTGTGGTGGCT |
| CCTAAGTTCGACGT | GTCTTGGACACTCT | TGTTATCCGGGATC | GTCGATTTATGCAG |
| ATGAGTCTCGCCTG | GTGAATCGGTTTCA | ATGTAGTAAGTTCA | CGTATATGTCATAC |
| AATGTAAATCTGCA | TACATGCTTTCGCC | AAGACGTTGCTCT | TTATCGTCCGGATC |
| CCTCTACCCAATTC | GGTGGACTTATCCT | GTGGATCTTATAGA | TTATGGGTACGAGT |
| GTTGGTCGCAAGTG | CGCTTGGAGTTACT | ATCTGGGACATTT | TGTTTCGTCCCCGG |
| CGCTGCCTACTTAG | TCTGGGTACCTTGG | CGTTCCTCTGCCTC | TCTCAGACTTCTGC |
| TTAACAGAGATTGG | CGGAGTATTGATTC | AATACCTCTCTCTA | CTACCATATGTCTG |
| TCAGTTAGGTAGCG | CAGTTGAATGTGAT | CGTCGCTTCGTTAG | GAGTTGGACGTTTC |
| CACAATGTTCTCGG | GATATAGGCTTGTC | TGACCTTATCCGTG | ATTAGCCTCTTCAG |
| ATCGCTAGATACTA | TACATCTCCATTAG | TGCCCATTGATGGT | CTATTATGATACGA |
| ATCTCGCTTAGACC | TGCGCAAATTTCCT | GGTGATGCCTTAAT | GTATCATACCTTGA |
| CGTCTCGTCGGGCT | ACGTAGTCATATAT | TGTGGAATCCGCTT | TTGTATAAACCCTG |
| CATTCAGCGCAGTT | GAAATACGTGTTCT | CCATTAATCCTAAT | TTCCGCGTAAACTT |
| TGGCGGTTGTGCAC | CTCAGGTAGGTTTG | TCAACGAAATTATT | TACTTGTAAACTAA |
| ATAGGTGTCATAAA | GATCGTTGCGATGT | CCGCTCTTTGGGTA | CCCCTTTTCAGGA |
| ACCGTCTCAAGTTG | GGAGTTTGTATAGA | CTTGCCATGAGATT | TTTAGTGAGAGCCT |
| AAAGTCCTTTCGAG | GATTCAACTTCTAG | GTATTGCAGCTTCC | AACTTTTCATAGAC |

FIG. 7 (Cont.)

| | | | |
|---|---|---|---|
| CGCCTATATGGTTC | TCATGTATATCTGA | TTCTACTGTAGACT | TCGCTTAGTAAGTT |
| AGTCTTCGCCATTC | AAGCTGTCATTTTA | GTCGGCCTTTGTTC | TAAACATGCATTTT |
| TTAGACTAGAATCT | TTCCTTCTCCAGTA | CATGACTTCTGTCT | GTTTATCCCTTCGA |
| TGGAGCCTTAACTT | ATATCACGATTTTA | ATGCTGTCTCTGCT | CGATTGATTCTTCC |
| TCCGGCTGTCATAT | GATCTCATTTTAAG | TGGCGAGTTTTTGC | ACTGTCATCTTGTA |
| ACGTTATTGTCCGA | ATCTATGAATTGAT | ATTCGTTATCTGCC | GACTTCGTTTGCGT |
| TCTGTCCAACATAT | TCTTGTGTCGCATA | TTTTTGAACTGGGC | TTATATGAGGTTGT |
| TGACATCATTTAGC | CGTGTTTCAGTAG | CTTCGGAGCTTTTG | TTTCAAGATTCTTC |
| TGATTTCCGCTAAA | CGTTTCACTCATCT | CGTGATATTATTGA | TGATTTATTCCATG |
| TTATTCGTAAGCGC | TTCATCCACTCCTT | CTATCGGTAGTTAT | TTAGAGCTTCTTCT |
| TTTCAAACTGACCT | TTCTTATGGTCAGC | CTATTAGTTTGAGG | CGAATGTGTTTTTA |
| TGTAACTAATTGCG | TCTATGCGATTTAA | TTAACTCTCCGTGT | GATGTCTACTTTTG |
| TCACTTTTGGCCGC | TTCTCATATCCCGT | TGCTTCTGAGTTAA | TCTGTTCGCTCATT |
| TGGTTCTGACCGGT | TACGTCTATTATAA | TCTCACGTTAGTTC | TTTGGTTCAGTGTG |
| ACGTGATCTTGGAT | TGACTCTCTCGTTG | CCTGTATTGTACTA | GCTACTCCTTTTAT |
| GCTTGTTCCTAACG | GTTAACGTATATA | GTCATTATATCTAG | ATTGGTATTATGAT |
| CTTACTATAGGGCT | TTGATATCTCGTCA | TTTATTGATGAGGG | CGATTACTATTGT |
| TTAAGGGATAGTTA | TAATAGTCTCCTCT | TTGTATTTCAACGA | TTAGCATATCATTT |
| GGCTTCTTCGCAAT | TGAAGTGTTCATGT | AAACTATTTCTGTA | TGTTCGAATCTTTG |
| ATCATGCTTGAGTA | TAATTTCGTCATAG | ATTTCTCAAGTCTC | CCCTTGTTCTTCTG |
| ATCGTCTCTATCAA | TATTAAGCTTTGGA | CCTGATGTATACTT | ATGTCTGTTGTTAC |
| TTTGACTTCCAAGA | CGTGTTGATCATTC | ATTAACTATGTGAT | TATGTTTTACACTA |
| TGTGGCCTGTTGCC | ACTTAGTTGTTAGC | ATGTGGTGTAATTC | TTTACCTGTTAATG |
| TTGCCTAGGATGGT | TTAGTCTGGGAGTT | TATTCACACTTATC | ACTTTATGTGTTAG |
| TGTCGTGACTTAAC | AATATTCTGTTGCG | TTCTATTGCGCTCG | ATGTGTTCCTGTTA |
| ATCTTAGTAACTGA | GTCGTCATGTTGCT | TTCATATACCATTA | CTCCCTTACCTTTT |
| CCCTTTCTACGTGA | TATCTAGTCCTTGG | CTGTCCTTCTGGTA | TGTCGTTGTTGTGC |
| CTATGATACAGCTT | AGATCATTGTTGTA | TTTAACAGTCTTGC | AATTTGCGTTTTAC |
| CTGTTTGGGCCGCT | ATTTTCCCTCGATC | CGTATTTAAGGTTG | TTTTTCCGACTGTG |
| CGGTCATGTCCTTC | AGATTTCCAGATTT | CTAGGGATTTGTAT | TTTTAGAGTTTCCC |
| CGATACTGTTACAT | TCATTATACTGATA | CGTCTATTTTGACA | GGCGTGTTATTGTT |
| GCTTCCTCACTTCC | TCCTCTTTGGGGAT | CGTACCTTCTTCGT | TGTGAACTTTTTAG |
| CTTGGATGCTTGAC | GACATTATCTAGTT | CTTACATGAAATTT | TCCAACATTTTTCT |
| TTCCTTCCGGCTCT | GTTCCATTGAATTG | TAATTAGGTTGTCA | TATTTTTGGCCACT |
| TCGCGTGATGTTGT | GTGATATTCACTTC | TTATATTTAGGCCC | GATAGTTATCTTAT |
| AAGCGTTACATTTT | GCTTATGCTTCCTG | CTTTGTGTCAACAT | GTTATCTTATGCCT |
| TTTTCCGACTGTAC | AGTTCGCTTTGGTG | TCTGGTTGTGCACT | GTTTCTGCTTAGC |
| AGTTCCTGCGTGT | GTGTATAACCCTT | CTAACATGTCTATT | ATTTGGGAGTGTTT |
| TACAGTACTATTTG | GATTTCTTTCCAGC | CTAGTATTCTGTCC | TGTTATGTGCTGTC |
| GTCTGATTGGGTGT | CAGCTTCATCTTCT | TAAGACTATGCTTT | GGGTGTATATGTTT |
| CGAACTTTTCTGCT | TTCGTATTGAGCCT | TTCTGTATGAACCT | TGTGTCTTATGGTA |
| GAATATGTGTAGTT | TAGGTGTTTAGTGA | ATGTTGCATACTTA | TATTGTACTCTACT |
| GGTTGCCTTTCTCG | CCCATAGCTTTTTA | CAGTTTATTCATAC | CCTAATGATTTTTC |

FIG. 7 (Cont.)

| | | | |
|---|---|---|---|
| GACTGATTTTGATT | AAGGGGAGGCCCGG | CGACCCAAGAGAAA | ACCACACTCAACCA |
| TTTGGATTTGGTCT | GAGCAAGGGCACCG | AAACCCACGAAACG | CTAAACCCGGGGGG |
| CTTATTTTGCATTG | GGCCGACACAGCGC | GAACGCGAGCCGGA | CGGCATCCGACGAC |
| CTCTTGACATTTTT | CAACACGCGGAAGC | CACGCAAAAGAGGA | GCCGATAGCCCGAC |
| CATTTACCTATTTT | GAAACGGCCGCGGA | GCGGCACACGAGGA | AAGATCCGGACGGC |
| TTTGAATAGTTGTT | CACCAGAGGACGGA | AGGACGCAGCCACA | CAGCAGGTAGCGAA |
| TGGTTTATGAATTT | AACAACGGCGCCCG | GGAACGGGCAGAAG | GACACCCCAAATGC |
| TATTTGTTCTCTAC | ACACCCACACCCCG | CCACGGAGGAAGGC | GACTAGCCACCACA |
| TTTTGATACTTCTG | CACGAGGCCAAAAC | CCGACACAAGAGCG | GCGCAGCTACCAAC |
| GTACATTTTTCTGT | AAAAGGCACCCAAC | GGAGGGGGAGACCC | ACGATCCGGGACCG |
| TTGGTTTTTGACTG | CAACACCGAGCCGA | AAGCAGCCGGGGCC | CGCCAACCAGATCA |
| CTCTTTCGTTTCCT | GGCAAGACAAGAGA | CGCCAGCCAGGAAC | GGCAGCCGGATGAC |
| TTTTATGCTCTTAT | ACGACGACCCAGCG | AGGACGGCAGGCAG | GAGAACGCGGTCGG |
| CGTCATTCTTTTTT | CACACCGAGGCCCA | CACGACCAACCAGG | ACCACCCGAACATA |
| GCCGCAACACCCGA | AAAAGGACGAGCAA | CAGCCAGCACCCCC | GACAATAGCAACAC |
| GCGGAGCCAGAGAC | AAGCAAAACGAAAG | ACCCACGAGAGCAA | ACAAATGAGCAAGG |
| GAACCAAAACGCGC | AGCACGCCAGACGA | GGGCAAGGAGGGAC | AGATGACCAACCAC |
| CGAACACCAGCCCC | GAAGCACGCAGCAC | ACCGGAGGGGAGGC | AGGGACTGGCGGGG |
| GGGAACCCCACGCG | CCGCACAGCACGCC | GCGAGAACGCCGAC | AGGACCGGACCCTC |
| AACGCCAGCGACCC | ACGACGACACGAGC | CGAGGAGAGCAGCA | GCAAATCAAGGCGA |
| CCAGAAAGGAGAGA | CGGGGAGCAGAAGA | AAACCGAGCCAGGA | AAGACAAAAGGCTA |
| ACCCACGGCGAGGA | CCCAAAGACAGCGC | CACCACGCGACACG | TCGACCGACCGAAC |
| ACACAACAAGAGGA | CCGGAGCACCACCG | CAAAAACGCGAGGA | CAGGTCCCCAGGAC |
| ACACCCAGCGCAGA | GCCCAGCAAAAGAG | AAGAAAAGACGCCG | GCGGATCCCACCGG |
| GGAGACCGCCAACG | AGCAGACGCGACGC | GCACAAACAGCAG | ACAGGACTAACACA |
| GCAGGGACCCCACG | AGCGAAAGACACAG | CCCCAAGGGAGGAG | GAAGGATGCCACGC |
| GGACCGCAAAAGCC | ACAGGAGGCGGACC | AACAACGAGCAGCC | AAAAGAGCCTGCAG |
| AGCCAAGCGGGGA | AGCACGCAAGGGCG | CCAGAGAAAACCC | GAGCGGAGCTAGCA |
| AACACCACGCGAAC | GAAAGCCCGACGCA | ACGGAAGAAAAAG | ATCGAGCGCGCGCA |
| CGCACAGGCGGAGA | GAAACGCAGACCGG | GGAAAGCGCACAGA | GAACACCCTCCGCC |
| AGACCGGACGGAGA | CAAGCCACGCAGAA | ACCAAAAACAGACG | CCGCACGCTCAACC |
| CGCAGAGAAGAGAA | GCGACCCGGAGAAA | AAACCAACAGAAAC | CGAAGAAGTGCAAG |
| GCGGGAAGACAGCG | GCGAAAGGCGCGGA | GACGGACGGCAGGG | GTGCAAAAAGGACC |
| GAAAGAGGGGCGG | ACACACAACAGAGC | GGGAAAGAAGCGCG | GGCCCAACCCTAAG |
| CAAAGACCGCGCCA | CCCAGAACAACGCG | CCACGGAGGCCAAA | GCAAAGAAGGTCAA |
| AGGCAACAGAGGGC | AAAACGGGAACGCC | CGGAACCCACCCAA | GAGACAATCCCCAG |
| GGAACAACGCCCAA | GAGACCAACGGAAA | AAAACGGCAAAAAG | CAGCCAAACAGTAG |
| CGCCAGCACCCACG | GAGAGCCACGAGCA | GCCTGAGGCGACAC | AGGTCAGGGACGAC |
| AAAGCGGCGCCGGC | CGGAAACGAGGAAG | CAGGGGTCCCAGCG | CAACAGCCGCCGTA |
| CGGAGGGGAAGCCG | CAAGAGAGGGCAAG | GCGACTAAAACACC | CCGCCAGGACTCGA |
| AAAAAGAACAAGGC | CGACGCGAAAGCGG | GAGAGGGGTAGGGA | GTCCCCAACGAAGC |
| GGGACAAGAAGCGA | CACGGCACGCGACA | GAGTCGCGAAGAGG | ACGGGCACAAGCAT |
| CGAGGCCAAAACAA | CAGAGCCGCAGCAA | AAGGAATCACCGCC | ACCCGATGGCCAGG |

FIG. 7 (Cont.)

| | | | |
|---|---|---|---|
| AACACGCTCCGGGA | ACCCTGCGGGACAC | GAATGCAACGAACG | CCAACACGGCCATC |
| TCAGGGGCAAGCCC | GAGGCAACGCAATA | CGCCCAAAACAGAT | CCCAGCACGTGGGG |
| GAGGAGGTGCCCGA | AGCGTAAGCCCAAC | GCAGAGCCCGACGT | ACGCATGACCCCCC |
| ACGCTCCACAGCGA | GAGACCCTAGACGA | GACCGAGGACCTGC | CCCTCCACCGAACA |
| GGCCAGGCGATCGA | GCCAACCCACACCT | AGAGTCCCAAGAAC | GAGCCCGAAGAATA |
| GGCTCGGAGGAACC | CGAACCGTCAACAG | GACCGCACATCCCC | CCAGCATAACGGGC |
| CCAGAGACCGGTAC | AACGCTGGCAGAGG | ACAGGGAGGTGCAG | ATCACAGCCGAGCC |
| CCAACGAGGGCTCG | CACAGCGGTCAGAA | CATCGGCAAGCAGC | GCCACCCAGCCTCC |
| CAATCCGACAGAAG | CACTAAGCGGCGAC | CGGACATACGCACG | GGATAACCCGCAAA |
| ACGCTCACGCCGGC | GCCCGTACCGCACA | CTGGGAAAGCCACA | ACGCATCCCGCCAA |
| CGCCGATCGGAGGC | AGCCCGTGACAAAG | CCACCCCACTAAAG | ACGAAACAGTACC |
| AAATAACGCACCGG | CTGAAAAGAGACGA | CCGCCATCAGGCAC | TGACAGGACACGAG |
| AGGTAAAGCGACAA | GGGAACCAGCTGCC | GAAGAGAGATAAAA | GCAGGCAAAATGGG |
| CCCGAGCCTGCAGG | CACCTCACCGCGCA | GCAGCGGTCGAAGG | ATGACACGGAGAGC |
| CAGGCCACCCTAGC | GCCCCTCCGAGAAC | ATCGACCAGAGGGG | ACAGGTGCCGACCA |
| GGCACCCGGAACCT | CCGAAGGGCATAA | AGGCCTCAAAGAAC | GCCGAACGGCACAT |
| AGTGCGGAGACAGC | GAAATCCGACACCG | CCAAGCGTCGAAGC | AAGTGGGCCGGCCA |
| GGGGCACTCCCAAC | TGGAAGACCGGAGC | ACCGACAACTCGGA | GCGAACGCTGGCCC |
| CAGCTCGGACAAGA | TGGGACCACCCAAA | GGAATAAGGAGACC | GCAAAACGACGTA |
| TCACGAAACCGAAA | CGACAATAGCCAAA | CTCCGACCACCCGC | GGAACAAAAGTGGC |
| AAGCTGGCAACCAA | GCATGGAAGGCGCG | CGACGTCCACACCC | ACGGGCAGGAAGTC |
| AGCGGGTAGCGCAC | AGAGACGGATGGAC | CAAAGCACCAATAA | CCCACGAAATCGCC |
| ACCAGGGTCGGGCC | CATAAGGCGGAGCG | GGTGCAGGGGCAAG | TCCGCAGCCAGGAC |
| CTGCCGACGGGAGA | AGAGGCCGTGGGGA | GCAAGCAGGGGGTG | TCCGAGGAGCACAA |
| GCGCTAGAGGGGCC | TGGGACCGGGACGC | CCGGGACAGACGCT | CACACCAGTAGAGA |
| GGTAGGGCAGCACG | CAAAAGGCCTCCCA | CACCGCGTCAGCGA | GCCCGAGTCCGAGA |
| GCAACGGCATCACA | TGGGACACAACGGA | CAAAACCTGAACCG | CGCGACCGCATGCC |
| CGAGAAAGCAAGTG | AACACGGTCCCACC | GCACCCATAGGGAC | CACCAAATACCCAC |
| AGACGCCTGCAAGG | GACGCTCAACAAAG | CTACACACAAGAAG | AGACCTACGCCAGA |
| CATAAAACGAGCGC | CACATGGGAGCCAC | GTGCAGAGGGACAG | CCCGAGGACTGGAC |
| ATGAACACCGACGC | CGAGAAACATACAA | CAAACCCCGATAGG | GATAACCGGGAAGG |
| CCCGGTGGAGAACA | AGACACGTACCACC | GGGTACACGAGACC | ACCTCGGAACAAGA |
| TGGACAGCAACAGA | AAGCGCGAACCTCA | CGAGGTCACGGCCC | GCGAGCGCAGATGG |
| ATCACCGGAGAACG | AGCCCAGCCTGCAA | GTGAGAACACGAGG | CCCGCACCTCAGCA |
| CACGCCTCGGCAGC | GTGGCACCAGGAAC | CAAGAGTCAGACAC | TGCAGGGAGGACCA |
| GAGCGCAGGATCGG | AGCCTAGGAGCGGG | CGAGAGTGACGCAG | CCGACAGACCATGG |
| AGCCACCATAGAAG | CAGACGCCCATCCC | CAGAGTCAACACAA | GACGGCAGTGCAGA |
| TCACGCCAACACCA | AGAAAGTCACAACG | CTAAAACAAAACGC | CACAAGAAATGGGA |
| AAAGCGTGCACAAC | AGGCAGTCCCGAGA | AAACAGGGCCATAG | AACGGCCAAGCACT |
| ACGAGCCGATGGGC | CGGTCACGACACCA | AAACCAGACCCTGC | GAAGGGCTGAACGA |
| TCCCCCAAACCAGG | GTAACCACAACAGC | CGAGGGACAGATA | CAGCACACCATGAG |
| GTACCCGGAAGACC | AACTGGACCCACAG | AGGGACCAGGGTAA | GGGAAAGCGGAAAT |
| GCGTGACAAACCAG | CTCAAAGCGCGAAA | CAGCCTACGAGGCA | GGGAGGACGCAGTG |

FIG. 7 (Cont.)

| | | | |
|---|---|---|---|
| GGAGGAATCGAACA | ACGAGAGACAAATC | ACACCGAACGTGCC | CGGAGTGCCGGAAG |
| AAAACAGCGCAACT | GGTCCCCAAGAAG | ACCGACCAATGCCC | GGAGCGATCCGCAC |
| TCCAGACCGGAGAA | GTAGGAAAGACAGG | CCACGACGGTACGA | AGAACCAACATGAA |
| ACTGCGCACAGGAG | GTGACGGCAAGCCC | ATGCAAGGAAAACA | GGGACCCATAGACG |
| CAAAAACCTAGGAC | AACCGAGCCCCAAT | GCAGCGCCACTGCC | AATAAAGAGCCCAC |
| AGCAAGAATGAACC | GACGGACCGAGGTA | TACCAGAGACGAGA | TGGACGGAGAGCGG |
| CAACCGCGATCAAA | AAAAGGATGACAGC | CCATCAGGAGCAAA | GAGACCACCGATCG |
| GAGGGACCCCTCCG | AGAAGATGCACAGC | GAGCGATGGGCGGC | CGCGAGCGCAACGT |
| CACTGCCCAACCAG | CGAGAAGCGCCGAT | CCGCGATGCAGCAG | AGCCCGATAAACAA |
| CGGAACGGCGAGAT | GCACGCACTGCCGA | AAAGCACCGATCGA | TGAGAAGCAAAAAC |
| AAAAGACGGCCCGT | ATGCCCCAAACCCG | CCCAAATGCGGGCC | AGTCCAGCGCCGCG |
| GACATACAGGCCGC | AAAACGCCACGATA | CAGCCCAATCCGGC | CGACCTGCCCGAAC |
| CGACGAGATAAACC | CCGGATAAGGGGCC | AGAACGAGTAACCA | GAAAACCGTGAGA |
| ATCACACCCGCAGA | GACAAGTCGGACGC | AGGGCGAAACACTA | AGACGTCCGAGACC |
| ATGGAAGACGGAGA | ATAAACGCACCAGG | CGATCAGCGGGACA | CCACTGCACGCACA |
| CTGCGGGAGCAGAC | AAGTCAGACCGCCC | GGCCTAAGGCAGGA | CACAGAGTCCAGCG |
| AACAAAAGATCACA | GGCGTGCAACGGAG | CCAATACAGAGACG | CCTAGAGAGCCAGA |
| CAACAACACGTACC | GAGAGACCCCAATC | GAAAAGCGCGAAATA | CAGGGATAGAGCGG |
| GGGCACAACAGCTA | CCCAGCCTCAGGGC | AATGAACGAGACAC | CAGGCAGCCGCAGT |
| GCCTGCAAGCGCCA | GGGAAATCCAGCAG | GCTCAAACAGCCAC | GCACGCACGTACCG |
| TGGGCGAGCCACAG | AAACACAGGCAGCT | AAGCGCGACGAACT | CAAAAGGTACACCC |
| ACCTGAGCCCCCGA | CCACGGTACCAAGG | CGCAAGAATAACGA | CCATAAGAAAGAAC |
| AACAGGCAGGACGT | CAGTGCGGGACGCG | AGAGCCGTGGGGAG | CACCTCCGGAGCAG |
| AGGCGGAATCCCGC | CGAGCGTAAGGCGA | GGACCCACGCAGTC | TGAAGCAAACAAGA |
| ATCCGAGGCCCCG | GGAACCCTAAGGGA | ACCGTAGCCAAAGG | CCATGGCACAAACC |
| GCGCCATGGCGAGC | GGGATGAACAAGAG | GAACGCACGGGCTC | AACGGGACCGATC |
| CGCGTGGACCACGA | GCGGTGCGCAAGGG | ATGCACAGGCCAGG | AACTAAACGCAGGA |
| CAAACTACCCACGA | CAAACCAACTGGCG | AGGCAAAAGCATGG | CGTGGCCAGAGGCA |
| GCAGCCGACCCACT | GCCGAAGGAACGTG | TACCGAGGCGGGGA | CCCCTACGAACGAA |
| AGTGGCCCACGGGG | GCACGAAGACCCTA | GGACGATGGCACAA | CTGAGAGAAAGCAA |
| ACAAACGGAGCAAT | GAGCCTAGCGCCGG | AGAGCATAGCGGAA | TCGCCCAGAAGCCC |
| GACACTGCGAGCGA | TACAAGCACACCGC | AGCCGGACACCCTA | GATCACGCACGCGC |
| CCACGAGCGGCTGC | GCCGCAAATACCAC | AATAGAGGACAGGG | CACGCACTGGCACA |
| AGGAGAGCGCTCCA | CACTCACAGCCAGC | CTGGCGACGACCAG | GGGAGCCCAAATAA |
| CAGCAAGAGTAAGA | CAGAACCCTCGCCG | CGCAACGCTGCCGA | ACACAGCAAGGTCC |
| GGGAAGTGCCGGGC | AACCACCCTAGAC | ACCGCGATGCGCCC | AAAGGAAGAATAGA |
| CTCGAACCGACCCC | GATCGCCAAACCGG | CCGCAGCAGCGATC | CGACGAATCGACAC |
| CCGTGCAAGACAGG | TAACCAGAAACACC | GGATGAGACACCCC | GCGCTGAGCGGAGG |
| GCACGGATAAACCA | CACCTAGGCCGGAC | CACCGTAACACCCC | GCGAGAACGGGCCT |
| ATGGCAAGAACCAC | ACGCAAATGCAGCC | GCGTCGCGGAACAC | CGCAGCGCACGAGT |
| GAGCGCCTACAGCG | AAGCGGACCGCTGA | GCCCGAACAGATCC | GTCCGGACGGCAGC |
| GCTGCCCAACCGGG | TGCCAAGGGCCGGC | AGGGAAGAGCTAAA | CTGAGCCAGACACC |
| GAGGGAGAGAGTAA | CCCGAGTAGCGCGG | ACGAACCTAAACAG | AACCATCGGGCACA |

FIG. 7 (Cont.)

| | | | |
|---|---|---|---|
| GGCAGAATAGGGGA | GTCCCAGACGCCCC | GAAGCACGCGAGTG | CACATACGCCCCAG |
| GTCCAAGAACAGGC | AAACGCGCGCGGTG | ACGGAAACAGGCTG | AGGCCCAAATACAG |
| AACAAAGCAATGAG | GGGAAGCAGGCATC | AACATAGGGAAAAG | CGGGCAATCAGAAA |
| GCCGAGTCGGAAAG | ACGAAAGCATGCAC | GCGAGAGACGTAGG | GGAATCAGAGAAAG |
| ACAAGACCACAGTC | ACGCAGTGGAAGAG | GAGTACGGAAGCCA | GAAGATACAACCAA |
| TGCCGGACCCGAGC | AATACGAAAACACG | GATCACAGAAAGAG | CCGACTCGAGGGAC |
| CTGGAAGCAAGGCA | CGCGGAGAGAGCCT | GAAGGGCTGGGGCC | TGGGCGAACCCAGC |
| CCAAAACGACGTGC | CATAAGCGCACACC | CCAGGAGCCGTAAG | AGCCTCGGCAGCAC |
| AACGACAATGACGA | GGCAAAAGTAAGCA | AGACTCGCCAGGCA | ACTGCCCAGAAAGG |
| AAACAAGCGCACTA | CAGAGTGGCGCCCC | GGACAGTCCCCACC | CACCCCCACCAGTC |
| GAGGGGTACCCAAA | GCACCCTCAGACCC | GCGCCACCGAGTGA | CCCAGAGAACGATG |
| CCGACGCACGACTA | GAAAACCGCGACAT | GCAGCCCAGAACTC | CGTAGACACCAAAC |
| GCAAAGATGAGGAG | AAAAGTGGCGCAAG | ACAGGAAGTCACCC | CAGCCATACGCGGA |
| AAAGACTAGGAAAA | CACAAAGAGCCGTG | ACTAGCCCAACAGG | GGGTAACAGAGAAG |
| TGACCAGAGGGCGC | AACCTACAAGCGCA | GGCCAAGAGCATAA | CACCTGCACCGAGA |
| TCGCAGGGGAAAGA | CAGATAAGCCCGCC | CACAAAGAAATAG | GAGGATAAGAGAGA |
| CGATGGAGGAAAAG | CAAAAACCACATCG | TGAGCGGAAGACAG | GGGAGACACCAGGT |
| GACCTCCCAGCGAC | CAACCCCACCCCCT | CGAAGAACCACTG | CCGACAAGCAATCC |
| AGCAATAACAGGGA | CCGCGACCTAACAC | CGGAATGAAGCAGA | CCAGATGCTAAGGC |
| CACCGGAGGTCACC | AGCGAGAAATCGAC | ACCCGTGAGACCCG | AGGATATCAGAGCA |
| GAAGACTGAACACC | ACAAGACAATAACG | TACCCGCAACAGCG | GTACACGAGGACCT |
| GGAAATCGCAGGAC | GACTACACGACCGA | TAACCGGGCGGCAC | CGAGTCCGGTCGAC |
| AAAAACAAGGACTG | AACAACGCGACTAA | GAGAAACCCTCGAC | GCATGGACTCAAAC |
| GGCGGTGCAACCCA | CGCGTAGGGCAGAG | ACGGCAAGGAATGA | GTAGGTGACGCGAG |
| GGTGCCACGACACG | AAACGGGAATGAAG | GAGAATACACCCCC | GAGCGGGAGTGCTA |
| ACCCAGTGGACACC | GGCCAGCAACGTGC | AGGGTCCAGGCACG | GGAAGGCTGGCGTA |
| GCAGCATAAAACAG | GAACCGAAGGGAAT | GGGTAAGCAAGGGG | AGCAGGGGGTCTCG |
| GCAGCGAGAAACGT | ATAAAAGCAACCC | CATGGAGGGCGAGG | TAGAGAAGGAGGTC |
| AGCGACATCAAAAC | CGGAGCACGATAAC | GGACCGAAACGTCG | GGAGGCCCTGGTCC |
| CAAGATGCAGGAAA | CAACAGTGCCCAGA | CGACCAAGCTACGG | AGTGCGACCGAAGT |
| GCGACCAGCAAGTA | CCAGGCCACGTCGG | CGGAAAGTGGAGGA | CTAGCAGCAAGCTG |
| AAAACCTACGAAGG | CGCGTGCCCAGAGG | CCAGGGACCGTGGA | AGTTGCCAGAGCGG |
| AAAGGATGAAAGCC | CACCGCACACATGG | CCGACGCTGGAACC | CTACCACGGGGTCC |
| TCGAGGGCACGCGG | GAGGTCAAGCAGGG | ATAAAAGAAACCCG | TAGTAAGAAGGCAC |
| CCACAGACTCCCAC | ACCCCGACTGCCGG | GGGAGACACATAAA | CGTAGGACGGCTGG |
| CACGAGCGAAAGTG | CACCTGCACACGAC | GCGCGTACACCCAG | AGTCGTACCCGGCC |
| ACCGGAGGGAGCTA | GAGAAAAGAAATC | AGGACCATAAACCC | TACCGCCTGGCACG |
| GGACGTCCGGCAAG | AAGCGCAACCCGTG | GGGGTACGCCAGCA | GTTACACGCGCGC |
| AGCACACGCTGGCA | AAGAGATAGACGAC | AGGCCCAAGAGCCT | TGCATACCGCGAGC |
| TAAACGGCGGGCCG | GCATCGAACCGCGA | CGGAATGAGAAGCG | TCAGGCGAGGGTAC |
| GCGATGGAGCCCGG | CATGGACAAAGACG | ATGCCGAGGCACGC | AGCAGTACCGTCAG |
| CGTCAAGAAACGCC | CGAATAGAAACGGA | GGGAAAATAAGAAC | CGGGAGCGATAATC |
| GCATACCAGAAACG | TCAGAAAGGGCACC | CAGCGCAAGACTAC | CCGGTACCGTAGGG |

FIG. 7 (Cont.)

| | | | |
|---|---|---|---|
| ACCGGTATGCGAGA | GTGTGCACCCGGGC | CCGGTCCATGACAC | TGGAGGATCACAAG |
| AGTCACCCCTAACA | CGCTCGCGAGATGG | CCGTCGAATCGGCA | AAGCCACGGTATAC |
| ACGAAAACCCATTA | GAGAAGTTACAAAG | CCGAGTAACGCTGC | AAGGCTGGAGCCCT |
| CTACCTGAAGAACA | GAAGTCACAAGCGT | CCGCTGATGGACGG | AGTACCCGTGCGAG |
| GCAAGTCGCGATCC | GCATAGAGCAGGTC | CGGTGTAACCGCAG | GGAGCCTACCCGTC |
| TGGCACCGAAATAG | AGTTCGCGGGCCCA | TGCACCGAGCTGAG | AATCACGGGTCAAG |
| CCCTCGTGGGACA | AGTCACAAACTCAA | ACGTGGCCTGCAAA | ACAGTACGAGTGGG |
| GGATCTGCAACACG | GAGGAGCGTACGTC | CGCCCACACTTGAC | CGCGAGACTAAGC |
| GTGGACCATAACAG | TCGGAGCGGCTGGC | ACAACTATCCGAAC | GTAGAGACGCCTGC |
| CGGCTGCCAAGGCT | CGCGATACGCCTGA | TGACTACGACCCAC | TAAGCGAAACTGGC |
| CGACTCATACAACA | CAACGGGCTAGTCA | CGCGCAGCTCATAC | AAACCCAGATTGCA |
| GTAAGCTAGGAAG | CCTCCATCGAAGCC | CCTCGAGGTCAGAG | ATCGAATCGACAGA |
| ACGAACGGAGTTCG | TAAGGTGAAAAGGA | TGCCTCCAGGACCG | AAACGTAGACGTAG |
| ACACTGGGACGAGT | CCTACCTAACCCCA | ATGCCGAGGTGGCA | TAACGGCACTACAG |
| AGCATGATGCCGCC | CTCGTCGAAACAAG | GAGTATCGCCAAGG | CGATCACACGGGGT |
| GATCCAGCCGGGTG | AGGATAAACCGATA | GCATCTCGCCCCAA | AAGCTAGGGCGTGA |
| GTCGACTCAAGGGA | GACACAGTATACGG | GAGGATCGATGGCG | GTAGGTAACCGAGC |
| AAAGAGACCCGATT | ACTGACCAGCTACA | ACATAAGTGGAAAA | GGTCAACGCCTGCC |
| GGCAGCTCTGAAGC | TCATACGACGAAAG | ACGACAGCGAGTAT | GATCACGTCAGACA |
| CCGGTCTCAGCACA | ACGCGACGTTGAGG | CCGACACCCTCCTG | CAGCATGCTGGGCG |
| GACAGGATCAGTCC | CAGATAAAAATCGA | ATCCCACGTCACCA | CGAGCTAACGATAC |
| CCGATCGAAATACG | GGTGTGAAAGGCAC | AGAACCACCCGTTC | GCTGGAAACGTCCG |
| GCCGGTCGATCCAA | AGATACGCCAGAGT | ACACAGAGCTCTGG | GGGTGAGGTCAGAC |
| GACCAGCTCCTGAC | AAGGTCCCGCATCG | GAAAAACTTAAGGG | GGTCTACCGCAGAG |
| ATTAAGAGAACGAG | AGTACATAGGCGGG | GGGACGCCGATAAT | TTGAGCAGCCAAAC |
| CGTACAAGGATGGC | CCGCGTGAACGAAT | CGAACTCAGTAGCC | ACCCCGAGAGTGGT |
| TAGTCGCCAGCCAA | CTCGAGGGTCGGCA | GCTAACATCCAGCG | GCCCCACTACGTCA |
| GCCCAAGTGATACA | TGAACACATACCGA | TGCCCAGGTAAAGG | CTAGACCGATGACA |
| GAACGCGGTGTAAG | GACTGAGCTCGCAC | ATATAGGAACCGCC | AGCATGGAAGGTGA |
| GGCTAATAAAAAAC | ACTGGAAGACGGTA | GAGCTGGGATGCGC | TGCGCCAATACAGA |
| CAGACGGCACCTTA | AAGCCGCTACCCTG | ATGCGTCGCCAAGA | CGCCCTTCACGGCA |
| AACGGCGTTGACAC | GCGACGCTAGGGTG | GGAATGCCTAAGAA | GTGGTCGCGGAGCC |
| CCATATGGAGGCGC | ACCTCCTAGGAGGC | AAACGCCCAGTATA | GGTTGACCACAACC |
| GTAAGTACAAGGAG | TCTGGGGAGGGAG | ACTACCGCACGTAA | AGGAGAAGATTGGA |
| GATGCGACCCGTCC | GCCGATGACATGCA | CCGGTGAGAGGTAA | CTCGTCGGCGAAAC |
| GCTGGGTAGGCCGG | CTCCACACGGACTA | TCGGCCTCACACGC | CCCATAGTACCACA |
| ATCCCCTCCGGGGA | ATAACCGGGGGCT | CATGAAAAGCACCT | AAACCGAGGCTTCG |
| TAGCCCTCACGCCG | ACAAGTAAAGTAGC | GCATGCAGGGTAGC | CGCATCGGGTGCG |
| TGCGCGAGAGAATG | ACCCGGATATCGAA | TACGCTGGGAAGCA | GTCCGGACGCACCT |
| CGATCGAAAACTCA | CATGCCTGGAGGCG | ACTACCAAGGATCA | AAGAAGGTCACGTG |
| GACACACCAGCGTT | ATAAGTCGACGACG | TACGAGTAAGGGCC | CCCGGACAAGTGTA |
| GAACCACCAAGTTG | AGCCTGCGGTGGGG | GTCCTACAACACAG | GCGAGCTCAACCCT |
| CGCAGCGCGTCATC | GCGTGCGCAATAGA | GTCACAAGACCTCG | CAAGACGATCAGAT |

FIG. 7 (Cont.)

| | | | |
|---|---|---|---|
| AGAAAGCACGTCTA | GCGCTCGCACTCCC | TACGGCAGGCACGT | TAGGAATGGACGGA |
| TAGGACACGGGCTA | ACTCACCCGTGGAG | CCGAGCATACCTGG | CCAACTATGGAGAC |
| CTGAGACCTGGAGA | ACCACTCCAAGTCA | AAGCTGTGGAGCCA | TGGAAAACACGCAT |
| AAAGATAAGATGCC | GTAAAATCACAAGC | ATGGGGAGCTGCA | AAAACAAGATACGT |
| AAACAATCATAGGG | GGAAACATAACTCC | AAGGGACGTCATAG | TAACGCTGGAAGAA |
| GAGAGGGTGTCACC | GTGCGGCACAAGAT | GTGGAGAACCGGTA | GACGCGAATAGATG |
| CTCAGTGGACGCGC | AACGTATAAAGAAC | CGTACTAACGGACC | CAGGGCGATTCCGA |
| CCTTAGGCGAACCA | GGAAGGAACCCTGT | CCGTAATAGAACCC | TCACGCACGATAAA |
| GCCCCTAGACAATG | TAAGACGGGTACGA | GTGAACATGCGCGG | TATACAGGGGGAGC |
| AAGGGAAAACTATC | CCGCACCTGCGTCG | GCAAAAGGTGAGTG | CGGTCTCCGGAAAA |
| GGTATACCGACCCC | TACCCCTGCACCAG | GGACCGCACTCTCA | GGTCATAGACCGCA |
| TACCCTAGCAGAAA | GTCACGAACCGCCT | AACAGCACCTACTA | CTCGGGAGGTCCGA |
| GCTGACCACGGCTA | CCGCCACTCCAGTG | GCAGATCATAGGGG | GTGAAGGTGGGGCC |
| TGCGGCAAACGGGT | CTGCAAGGTCGCAC | GCGCCTTCGCACGA | AACTCGAGGAACTG |
| GCGTGGCACGTCCC | CCTCACGGCCTGGC | AATGTGGCACGACA | GTAGGGACGGTCCG |
| CGAACGCTGCGCTA | TAACCAATAGGAGG | AAAAAGCGTGCATG | ACCAGGCCTTGGAC |
| GGTAGCGGCACACT | GCAGGAGAGTACAT | ACCGATAAAGATAC | AACTGGTCCGGGAC |
| TTAGCCGCAAAGCC | GACGAGAAAACCTT | CCGCACTAGAGACT | AAGATCGGCGTACC |
| CGGCCATATGAGAC | AGAGCCACCAAGTT | GCCACTGTACGCAC | TCCCGAGCATCGAC |
| GGTCGGCCTACCCA | ACTAAGACGCAATC | GCGCTGGCGAACGT | GGCCAGTCAGTGCA |
| CATCCATCCCCCAG | CGTGGAGGCCCATA | GCTCCCGGATAACA | CGAGAATCGTGGCA |
| GCCGGATCGACCAT | CGGGGTTAGGCGGC | AACCTGGTCCAGAA | GGAACTAGCGTAAC |
| ACCCCAGGCTGACT | CACGAAGTCACGTC | CTTACCAGCAGCCG | GAAACTATGAAACA |
| AGAGGGGAATCTCC | GGCCTGTACGGGAC | CTGCCAAGGCAGTA | TGAAACCCTGACCC |
| CAATGTGAGGAAAG | CAATTGACGCACAC | AAAGCCTTAGGCAC | CAGAGCTGCCCATG |
| CTGCAGTCGCACCG | CTCACGGCTCACCC | GGAATTGCCGCAGG | ACCGGGAATCGGAT |
| AGTAATAAAAGCAG | ACAAGGGGAGTGTA | ACGATAAGTGGAAA | GCTATCGCGAAGGC |
| ACCACGCCGTCTGA | ATGGTCACCCCAAG | CGGCAAGTAATCGG | GACAGATAACTGCA |
| AAGCTCAAGGTAGC | CTAGCCCTCCGACC | CTACGGAACGGGAT | TGACAAAGAAGCTG |
| GGTCGAAATGACGA | ACACTATACACCAC | CCCGGAATAGCTAC | GGAAGAGTCGTGAG |
| ATAGGCAGACATGG | ATAAGCCATGCGGG | CCTCACCGAGTCCC | GGCGCTATGGGAAA |
| TGGCATACCCCCCA | TGTAGACAAGAAGG | CCGGAGTAAGCTAG | GAAACCGACAATCT |
| AGCCACTACGCTGC | CCCACACCGCTTAA | TAGAACGGAATCGC | CCCCTCTCACACAG |
| AGCCCCAAGTGGTA | AACCATCCAACGTC | AATCGGGCGGCGAT | CTAGGACGAATGAG |
| TAGGACGTGCGACG | CATGAGTGAAAACA | CGAAGCCGTCAATC | GGGGTGAGGACCTG |
| CTAAGAATCCGCGC | AGGCTCCGTCAGAC | AGCGGAAGCAGATT | CGTCCAGTGACCCA |
| CTTCGAACCACCGA | AACGCCTAACTCGG | CAGTGTGGGCACGA | GGACGCGGAAATAT |
| GTCACTACCCCGAG | AATCAGTACGGGAG | CGTGACGGGTGCCC | AGAAAAGACCTTGG |
| GCAGGAAGCTGGGT | CACCTAAACGGCGT | GTAAGAAAGCTCGA | AACCGGGTGAATGA |
| AATACGGCCATAGA | CCATAGAAACTAAG | AGACTACTAGCAGC | CGCACGGCCTACGT |
| TCAGGCCTCGCGCC | GTCAGTGCACAACG | CAGCGCTATGGACG | GACCACATGGTGCC |
| GGCCTCAAGCGTGG | TGGACCGGTGAGCC | TGGAGTAGAGAACC | CACGAACAGTTGCC |
| TCCCGCATCGAAAG | GATGGCGCTAGCAG | AATACACGGGACTA | CATCTACAACAGCC |

FIG. 7 (Cont.)

| | | | |
|---|---|---|---|
| GAGTGTGACCCACC | TATCAGAGCACCAC | GAACCCGGTAGGGT | GACATAAGTACGGG |
| GCCTGCATAACGAC | CACTCCAGCTCGAA | TTCACAAAGGGGGG | CTAAGGACAAGTGC |
| AAGGACCCTGATAC | CAGAGGCACAATTC | AGGAGGCCTCAGAT | ACTCAGCAACGGTA |
| GATAGTCGAAAAGA | GGGTAGCTGCGCAC | CCGAGCCGTGGTCG | GGCACCGGTCGTCG |
| GCGGGTCAACTCGC | CGATCGCAGGTAAG | CGAATGAATGGGAC | GTTCAGAAGAGGCG |
| CGTTGAGCACACAG | CCACGCTTACGCCG | CCACAGGTTACCCG | TGACGCTACGGGGG |
| AGTCGCGAGGACGT | GAACCCTCCATACC | GTCGCACAAATGCC | TCCGCGTCACGGAG |
| CAGGACAAGGTTGG | AAACATGCGAGGGT | GCGCTAAGAAAACT | AAGAACTGCACCTA |
| ACGACGGCTGATCA | GTGCGTGGGAGAGA | TCGTGCCCCAAGGA | TACAGCCATGACAA |
| AAATCATGACAACA | TACAGAGGCCTAAA | TTGCACCCAGGAGA | TGCCCTAAGAACCC |
| CGGCGTACAAGCGT | GCGGCAAAGCTTGG | CGGACGAGTAAGGT | CGAGCACTGAGTAC |
| GTTCGGAGACAAA | TGGACATCGCGAAA | GAATCAGGGGAGGT | CGCTAAACACTGAC |
| CTCGTCAGAAGGCA | AAGATTGGACGAAC | CAAGCATCCAATAC | GGCTATGGCCGCGG |
| ACGATGAGCGTGCA | AAGACTAAGAAGTA | ACACTCGTGCACAG | TTGGCGCAAGAAGA |
| GGGACCACGTGTGC | TGGAGAGAGCATAG | CAGGCGTGCGTGAC | TCTACCGCCAGACG |
| TACAGTGACAGACG | CTGGGTAAAGGGA | AGGTCCGGACGTGA | GCTATAACCAGAAC |
| TAAAGGACGCGAGT | GACTACCGAGGGGT | GCTCGCCCAGGTGC | TAACGATCCGCGCC |
| GTTGAAGGAACAAC | CCCAGCACCCACTT | GATCCTCCCAAGGG | CCAAGGCATAACAT |
| CGAACTGGATCGAA | GAATGGGACCGTGC | CGTGCGCAGAAATA | TGCCCGTGCAACCA |
| AAGTTCCACCCAGA | CATCGAAAGATAAA | TAGTAACCGAAACA | ACATGCTGGCGAAA |
| CCTAGGGAAACACT | AGTAGGCTAGAGAG | TAATGGGCACAGAG | ATAGGGAATAAAAG |
| AACAATCATGGGCA | CGAGTATACACACA | AACTCCGACCACAT | GGGAATAGTGAAAA |
| CGGCTGTAGGCAGA | AGGATTGAGACCGA | CGCCAGGTGGCATG | GCATCACCGGCAGT |
| GCACGTCACCGGTA | CTCACAGCGGCCAT | ACTCGGAGTACAAC | AAACCGCCGGGCTT |
| TAGCGGAGGGATGC | TCTGAACGGCAACG | GCCTATAAGAGCAC | TGACACAATCACGC |
| GAACCCACCTCCTG | AATCGGGACTCAGA | GCAGGAGGATGTAC | TAACGGTGGACCCG |
| CCAAGATGAAACTA | GAAAGTGGGTGGCC | TCATACGGACAAGA | CGACAAAGGTCAGT |
| TCCGTGCGCCAACA | CACTCGACGCGTAG | AACGCGCTGTGCGG | GAGTCGAGCACCTC |
| GACAGCGAGGTTAG | GCCTATGGGCGGG | AACTCAGCGATCAC | AGATGGATACAGCA |
| GAGATGAGGAATCC | CCTAACTACGGAGG | CCCCAGTAAATGCC | GCAATGCCCAGAGT |
| GCCACCGCGTACAT | AAGTCTCCCGCACG | TAACGAGAAAACAT | CTCACCCACCCGGT |
| CTGACACGCCGTCG | TCGGCCACCAATAG | CCCCTCGGGTCAAC | GCACATCCTCACAA |
| CCACTAGAACTACC | GAGAGCTGGCTGGA | CGACTCTCAACCAC | GTCTGGAAAGCCCC |
| CCCATAAATAAGAC | AATGCGACGCACAT | CCTAGGGCAGTGC | GAAAAGTCGGCAAT |
| AATCCCGAGCGAGT | GCCCACACGTGTCC | CGCAGGGTGGAAAT | GTGTGACCGGACGA |
| TTCGGACCCAAGAG | GATAAAAATACCAG | TAGCCCCACCATGG | CCGGTGCACCTGGA |
| CTAGGGGCACACTA | GTCACGCTGGGAGA | GACGAAGGTTGACG | CGGGACAGAACCTT |
| ACGTCCGTGCAACC | AGGCAGTATAAGCA | GTAGAGGGACTCGA | AGTGTAGCCGCCGG |
| ATGGCGCAGGGGAT | TACAACATCGAACC | ACCTGCCGAGTAAG | GGTGCCACCAGTGA |
| GAGCCGTATCGAGA | CCGAAGGGTATAAC | CGCTAACGTACAGC | TCAGGCCCAGACAT |
| AACCTGGGAATCGG | GTTGAGGGCCGCAG | AGCGGATGCGCTCC | GGGTCCCCAGACTG |
| ACCCGACTTGACGG | GCCAACTGCAAAAT | ACTACCACCACAAT | ACTGGGGAGCAATG |
| ACGATTAGGCGGCC | CGGCAATCCGTAAC | TGGACGGAAACGAT | CCCCGTCAATGCCA |

FIG. 7 (Cont.)

| | | | |
|---|---|---|---|
| CTCGGCACACAATC | CCGGGTCTACCGCA | GCCAACTACACTGG | GGCCCTGTCGAACG |
| AGAACCGTCCTCGC | GCTGAGTCGGGCCC | CCCTCGACTAACCG | CAACTTGCGGCGGG |
| ACAACGTGCATCGA | GGCTAGATAGAGGC | AATCCAGCTAACGG | AGTCCACGACGTCC |
| TACAGCGCAGGCTC | GAAGCAGTGTCAAA | CTGAAGGCGAGCAT | ACCTCGAGGTAGAA |
| CGGGTAAGGAATAC | AAAGTGCCATACGC | CGGCCAATCACGTC | CCTAACCGGAAATC |
| ATTACGGAAAGGGC | TCGATGGCGAAACC | ACCTCGCTCGCCGC | CCCAGCCGTGTCGC |
| CAGATGATGGCACA | CCCCGACTGCTGGC | GGGGCACATAATCA | CCGGTCGATCGAGA |
| GCAAAGGCGGTTGC | AATGGCACAGGTCG | CGGTACACCAAGGT | CCTATCGCCGACGA |
| TACAGGAAAGTGGG | TCCGAAGCGTGACA | CTCCATGCGAACA | GGCGTCTGACGCGA |
| CTCTGGAAGCGAGG | GATATGAACACAGA | GGAGATGAAATGAC | GAACTCGGGACTCC |
| CGAGTAGGAGCCCT | CCGAGCTCGGCAGT | TAAAAATCGCAGAA | GAAGCCGAGCTTAC |
| TCCACCAGGCTCCA | GACGGTAGAAGTCA | AATGAAAGTAGAAA | GAATGCCCGAGAAT |
| TCTACAAAACAAAA | AAACTTAAGACCCA | GTATGAAGCGCGCA | GGGAACATGAACAT |
| CACCAACAGATCTA | GACCCGGAGACTAT | TAGGGCCTAAGAAG | TGATCACGGCAAGA |
| GCAGTGATGCCGCA | CGCACGACCATTAG | GGATGCGTACGCCC | CCCATCCCCTAAAC |
| GGGCGTTGCACACA | CAAAATCATCAAGA | AAGGACGTATACGG | GGAATCGGAGGTCC |
| CGGTCCAAGGCTGC | GGTCTACGAGCAAA | CCGAAGGGCTCATG | TACATAAGAGGAAC |
| GCCGGTGAAAGTAG | TCACCGCAGAGATA | GTACTGAGCAACGG | AAACTCATCACCGG |
| ATAACGAAGCCGGT | TGGCGAGCGGCATA | CATGAAATCCGGCA | CCCGGTACAATGAC |
| CAATCGAGTCGGGG | GTTGCCAAACAGAA | CGTATAAACGAAGA | GGCTACCCGCTCGC |
| CTCCAGGCCAGCTG | CTGGTAGGGGCCAC | AGTAACTGAGGACG | ACTCAGCGAAACTG |
| ATTGGGACCAGGGA | GAAATCGACTACAG | CGACGCGTCCGTGC | ACTGTCACGGGGGA |
| CAGACTGCGGATAG | TGACCTCAGGGGAG | CCTACCCCAAACTA | AAGGCTGCGTGAAA |
| CGTAACAGGAGGCT | ACACGTGTCGGGGG | GAGTGCAGAGTGCC | AGTCTAAGACACCA |
| AGCCAGTTGCCGAG | CCTCGAGCATGACA | AAAGTCGGCAGCTG | ATCTGGAGGGAGCC |
| GGACGACGATTGAC | CCCGCTTAGGGAAG | TCCGGCATGAGGCG | CCGGAGACATTGAA |
| AATGCATACACAGA | TGTGAGCCGACACC | GTCGGGAAGAGGTC | GGAGACCCATTCAC |
| TCGAACATAGGGCC | GGCGGTTGGGAGCC | CCTGTACGAAACGG | CATCGTCGGAACCC |
| CGACGATCGGCCAT | GGAATCGAAACCAT | TGGAGGCCAATACG | AAAATAGGTGCGAA |
| CAAAAAGCTACATG | ACACTAGACGATCA | ATGCACCCGGAGAT | AAAACCAGATCTAG |
| AATGGTCAGCCGGG | GACTGAGCGCATCG | CTCGCCAGCATCGA | CGCACCTGAAGGAT |
| GGGGTAACCATCAA | ATAAGGGATGCCC | TGCTCCGACGGGCC | TACTACCACGGGC |
| GATCGGGATCCCCG | TCACCAACCGGCTG | GTACGGGTCGAAAC | TCTCCGCCAAAGCA |
| AAGGGAGTCCATGA | GGTTCGGCACGGAC | GAAGGAGACGTATA | TACCACCGAATACC |
| TCGGTGCGGACCCA | AAACATGGATCAGC | CTCACGCCGAGTCG | CGCGGATAGACATC |
| CAGGAGAGCCTTCC | AGCAAGTACTCCAG | AAGCAATGCGATCA | AAGAGTCAAGTGCG |
| AAAGAACGGCTTGC | ATCAAGTCCCGCGC | GAGGTCAATCGACC | AAAGAGATTACACG |
| CATAACATCGCGGA | GACGCTGGAACCTC | AGGACGTACCAATC | GCAGACCACGCTAT |
| AACCAGGCATGCCT | AAAAGCGCAGATCT | CGTCCAGCATAGGG | CACGCTGTGCGGAC |
| CGCAAGCTGCTAGC | AAAGTCAACTAACA | CAGCAAACTGCATC | CCTCGGAGACCTCG |
| GCTAGATGCAGGCG | CTAACTAACCCCCG | TGGGTACGGGGACA | AGGGGAGCATTAAC |
| GGACTGGGTAGCCG | TAAGCCGTGACCCC | ACTACACTACCGCC | GCATTGGACGGGGG |
| CGGTAGCACAGTAC | ATGGCCCTGGGCGA | CGTCCGCAACTCGC | TGAAAGAACAGTC |

FIG. 7 (Cont.)

| | | | |
|---|---|---|---|
| TAGCACTGAGGAAG | ATGAGGGCCTCAAG | GGCCACTAGATGGG | CCCACCACCCGTCT |
| TGGGCATCCACGCA | GGGAGGTCCTAAGA | CTGAGCGCTCCGG | TGACCGGGTCAGCA |
| CCTAAAAATCAAGC | TTGGCACAGACCGC | AAGCGTCAGCCCTC | CACTTAAACGCAAA |
| GTCGTACCCCACA | CACTTGACAACCGC | CATAGCCACCTCGA | CTCCCTGCCACCAA |
| GTGCGAGCACGGAT | AACATACGCAGCGT | GACTGACATCCAAG | CGCAGGTCCATGGC |
| CAAGATGGCCACTG | CACACAGGCAGGTT | TACAGACAGATAAC | GGTGTGAGAGCGGG |
| CGTCGAGCCTCCAC | CACCCACGACTTA | GCAACTATCAGCGG | TGAGAAGGCGCCTG |
| GAGGGTTCGAGAAG | GGGCACTGTCACAG | TGCGGACATAGACC | GCATAATGGCCGAG |
| CGACGTGAGACCTA | CTATAGCAACAGGA | CGAAGCATGAAACT | ACTGCCGGTGGGCA |
| GAGGCCGATGATCC | CTATAAGCGCACCC | CAAACAAGGAATTA | GAGCAACGGGGGTT |
| CACCTCCGTCCCCA | AACGAGCATAGAGT | GGAATATGCAACCA | GAGTCCACTGGAGG |
| GAATGGAGCTCGGG | AGTGCAGCGTACCA | AGCGCGAAGTATCC | CCAGTTCCCCAAAA |
| ACTGAGTGGCCCCG | CTAAGGAGCGTACG | CTTCGAAAACGGAA | CGAAAGGCATCAGT |
| AGACTAGCCACATC | CGTTCCGAGCCGAA | AGGGATCAAGTCCA | AACTAGACAAAGCT |
| CACGATGATCCACA | GGATAAATACGCAA | CATAGAGTAGCAAG | AAAAACCTCGCTCC |
| ACAACCGTACAATA | CGTCCCGAGTAACG | GGCTAAGAAACCGT | GCCGTAGATGGAGG |
| GAGAGCGGTCGCTC | TAACGTCCCGGACA | GAGCCTAAGATAAG | CTACCGATAAAAGG |
| CCAGGCCAAGCTTC | CTACCCGACCTGAA | ACTCCCTAGCGCAC | GAACTGATGAGAGG |
| GTGACGTGCCCGCG | GATAGATAAAACAA | CTGGACCCCCTGCG | GAATACTCCAACAC |
| TGGAACAGCCGTGG | ATACCGACTGACAA | TAACACGAGACTGG | GACATAGATAAACA |
| CCCAACTTAACGGA | TAACGCTCCCCCGG | CCCATAATCGGGAA | AAGCCGGTTAGGCG |
| CATCGAAAGGCCTC | CACTCTAGCGGCCG | CGGTAAGGGTACGG | GCCATCCAGCGGTG |
| GAAGCTAAAACAGT | AAGGGAGCGATTCG | CAATGGCACGCTAG | ACGTGCGACCTGGG |
| ATGCTCCCACCCGA | GACCGAATCGAGGT | GATAGAGTCCCAGC | AACCCTCGAGGTGG |
| AGCACAGTGTGGAC | CACGTAAGAAGCTC | CATCCTAGACGGAC | AGGCCACCGCTCAT |
| GGCTGAGACGGTGA | AACGAGGGATACTC | TTACCCAACACACG | AACACGCATTAAAC |
| TAATGCGCGGCCGC | CAGTCACGCGCCCT | CCACCAGTATCACG | CCCCCATCAACGGT |
| TGCCACGCACATCG | GCAAAGTGCTCCAC | AGCGACCGTTCGAA | TCATAGCCAGGGAA |
| GCCTGTACCAGGAA | GCACGCAGACGTCT | AAACACGTTACGAA | AGTTAGGGCCGCCA |
| GCGGGTACACGTCC | AGAGCGCGATGCCT | GAAAGCCAGGCATT | CGGAATGAATGGAC |
| GGGACCGAGCAGTT | AATGAGCTCAAAAA | GGGGCTAAGAGTCC | CGAATAGGGCGAAT |
| TGGGGCAAGGTGAC | AACCTGAGCGCCTC | ACAGAACGTCGTCA | ATTGAGAACGCCGA |
| CAAGGCATCTCGCA | CCCCAGTGGCAATA | GGCGCTCAGCTAGC | TAATCCAAGAACGC |
| AAAGTGAGCCGTCA | GACCGCAGGAATTC | ATATACCCGGCGCC | CAGGGCCTTAAGCA |
| GAATTCGGCACCAA | TAGCCACAGCGGTC | GACTACAGGCTCCG | TGAGGTACCGGGAC |
| CGAAGTAAGGTAAA | AAAGTCAGGCACTA | ACGTACTAAAGGCC | AAAGGCTTGCCGAA |
| AAGACCGTGACGAT | CGACCAGGGCTATA | AACCGCCAGTGTAA | TGGCCACGGCTACG |
| TACACGACCTCACA | CCATAAGCTCAGAA | CGACGTGGCGTGCA | AATCGTGCGGGAGA |
| TTGCAAGGGGGCGA | AGGCCTAGAGACTC | TCCAGACGCCCACT | AGGGGAAGCTACTG |
| GACTAAACAGCCCT | TAACAGGGAAAATG | CTAGGGGTCAACC | GTCTCGGGGAGGAC |
| CAACAACACTAGTG | TACGGAGGAATCCC | CGATAGAACTAGGG | ATCAGTGGGGCCG |
| AAGGGAAATACTGA | CACTGGGTAAACGG | CGAGGTAGCAAAGT | CCCCTGGGAGAGCT |
| AGACTGGTAAAGCG | CTTAGCGCGCGGCC | GCGGAAATCAGACT | ACAATACAATGGAC |

FIG. 7 (Cont.)

| | | | |
|---|---|---|---|
| AATCGAAAGTACCG | GCTCAGAACCGGAT | ACCTCAGGCCTGAC | GGTCCGCACTGCAC |
| GCCGTACCAAATAA | CTAGTGGGCAACAA | CTAATAGACAAGCC | GGTTGCGACGCGCG |
| ATAAAGCTGAGCGA | CCTGTAGCCCCCCA | CATGGGCGAATGGA | CCTCGGCAGGTCAA |
| AACTCCGGAGGTAC | TAACAGGATGGCCA | CCAAGACCTAATGA | TGCGTGCCCCACAC |
| TCCCTAGCCGAAAA | CGGGAACTGAGAGT | GAGCCGACTGAACT | TCGGAGTGACAACC |
| CGGCTGCACAGCTG | CTGCGCAGCCCACT | TAACTGCAACGACC | TGGCGCAACACGCT |
| CTGCCAAACTACCA | CCGGACATAAGTAC | GAACGATAGTCACG | ATAAACAACGATAA |
| AAATTGCGCGAACG | GTCCAACATGCACA | TAGCGTGGAAAAAC | CACGTCCCCATACA |
| AGGTAGCGAGTCGG | TGACAAGTAGAGAA | CCACCAGACGCGTT | ACTCGGACGGACTA |
| CGAAACGCGCTTAC | TTCGACGACCGGAA | AAATGAAGTAAGAA | CCTTGACGAAAAAC |
| GCATACAACTCCCA | CGACTGCCACCCGT | AAGAACCTATGGCA | GCCGTGATCGGCCG |
| CGGACGATCGTCAC | AACTAACTAAACGC | CAGTCCGACCCCTA | AATAACCAAGTCGG |
| CTGGCAGCTGCGAA | CAAGAGAGGTGGGT | GAGAGATAGGAGTG | CCCTGCGTAGGCAC |
| GCGAAATCCTACCA | TCGGTCAGACCAGA | GCTCAACAGCGTGG | CTAGGACAGCGGGT |
| ATCCCCAGAAGTGA | CGGATCGAAGGAAT | GGCAAAGATATAAG | AGCCGGTTAGGCCA |
| TAACAACTGAGCAC | CATGAAACTGCCGG | CTCCCAGATCGAGA | AACTATGGGCGGCA |
| CGACCCAAGCTGGT | CGCATTCGCCGCCA | GGACTCCGTGACAA | ATGAGGAAAGGGCT |
| GCAGGGGGATAATG | ACTAACCTGCCCGG | GCATAATGCCGCCA | CGATAGATGCGACA |
| GGGAGTCGGCCTAA | GCACCGACCTTGAA | GGGAGTCCGTGGGA | CTGAACACTACCCC |
| TATCAAGCAGAACA | ACTGCCCCAGTCAG | TAACGACAGCTACA | TGAAACACGGTGAA |
| CCGGCAAATACGTG | ATACCCGACGGTCG | AAAACTCAGACAAT | AATATGGAACCAGC |
| ATAATAGGGAAGGA | TGAGCCTAAAAAGC | ATCCCCGACGCATA | CAGTAAGGAAGGTC |
| GTGAGATGGAACGG | GATCGCGCACTAAA | CATGACGCAATACC | TAACCCGGTCCGAG |
| CCCAGTGAGCGGGT | TAACACGGCCGCTA | ACACTGGCGACTCA | CTGCCGTACGGGCC |
| AAATGCTGGGGCCG | TCGCGAGCCCACTA | CCCCGACGTAGCGT | GTGAGGACGGGTAA |
| ATGTGGCGGCCGCG | GGCCCTGACACCTG | TCATAAGAGAAGGA | CAGCCTCAGCAGAT |
| TCCTCCAGCCCGCC | CGATAGGGAAACCT | GGATGCAAATCCAG | CACTCAGCCTCCGC |
| ACAGCATAATGCCA | TGACTCCAAAGAGA | GGCAGGCTCCATCG | TGAAAAGGTACGAC |
| TGGCGAGACCTCGG | GCGCCATTAGACGG | AGCTAAAAGGCTGA | GGGTCCCCACTGGA |
| GATAGACAGTGGGG | CCCCAAGGATAGTC | ATTAACGAGCCGGA | CACAACGCGCATGT |
| GGACCCGTTGACGG | CAAAGTGAGCGTAC | TTAAGAGACCACAC | ACGATGGCGCGCTA |
| GGATGGAAATGACA | CCATAATACGCGAC | GGTATGGACCGGCG | GTAGCGTAGACGCG |
| CCTACCACACGGTC | AGGGGTCTAGCGGG | TAACGAAAGTGAGC | CCACCACAGATAAT |
| AACGGAAGAGAGTT | CGGACAGAGATCTC | AAGAATTCGACCAG | CGACGTGGTAGAAA |
| GAGTACGTGACCAC | GTACAGCACGTCAG | ACCCGCACCTTGAG | GCGCACGCATGCTG |
| GAGACTGCGACTCC | AGGCACATGGTGAG | GTAAGAGGCAAGAT | CGTTAGCGGCAGCC |
| CCCTGCGCACGTCG | TAAGAACAATACCA | AAGCCAGATTGGAA | TAGGATCGCCACCA |
| GGTGGAGAAAGAAT | AGAGCTAAGATCAG | GGCCTTAACAACAA | TCAGCCCGACCTCG |
| GTAACGTCAGCGCC | GCTCCACGTAAGAA | CCTGGATGGCGCAA | CGAAACGAGTTCGG |
| GGGCAGGCATATAA | ATTGACAACGAGCG | CAAATGACCATAAC | CCCCGTCCTCCAAC |
| GCAGCGGATCTGAG | CCACAAGATTCCAA | TGCTCAAGCGGGAA | GGTGACGTGAAACC |
| CTGACTCGGGCGGA | ACACCTCGGTGCAA | GAAACGGTAAAGGT | ATCTACACAAGGAC |
| CTGACCTGCAAAGC | CTGAGCCAGCGGTA | GCATCAGAGCCATA | AGCGAAATGTCGGG |

FIG. 7 (Cont.)

| | | | |
|---|---|---|---|
| GGGCAATTGGACCA | ACTGAGACCATGAC | AAACGCGTGCCCCT | TCTGCCGATAACAG |
| CCCGGAATATGCGG | GGAGAATGGATGCC | CGGCACATTACCAA | GAGCAATCTGCTGG |
| CAATGGGTAACAAA | CGCACGTACCTAAA | ATCGCGAATCCGCC | ACCTGTATCAAGGC |
| GAAATTGCCCGACA | GCCACGCTTAAAGG | GGCGAGTCCCCTAG | ACTTTGACCCCGAA |
| GGGATCCATGCAGA | GACATACAGCAGCT | GAATCGCATAACAA | TCGGCCAGATGGTG |
| TGCCGGAGACCAAT | AACCATGATCGAAC | AAGCTATAACCGAG | TCCTGATAAAGGGA |
| TCTGAAGAAAGAGA | AAGAGTCCGGGAAT | ACTCAAGGATACAA | ACGAGGCAGTCTTC |
| GACCCGTAGGGTCG | ACTCGAGCGGATCG | TCACCATCGGGACC | AACGATTGGCTAGA |
| CCACTTGGCAGACG | TTAAAAGGCACCGA | TCCTGACGCCGGAG | TAGCTGCCCATGAA |
| ATCTGACGCGGCCA | GGGATAAATCAGCC | CCCACCTGGCTAAC | TAGCAAATCTCCCG |
| AAGGATACGGCCGT | CTATCGAAAGAGAC | CCTACCCACAAACT | AGTAGCATTCGACG |
| ACGAAGGCCTGAGT | AACCACACTCATCC | ATAGCGAAGCATAA | AGCTGGTACAATAG |
| CCACTCCCGATACC | AATCGTCGGGAAAG | AGATCCCCATGCAA | TCGCATTAGCGGGC |
| ACGTCCCGTAACGG | AATAAGGGGTGGC | TGGAACCGAAGATA | GAAGGATTTGAAGG |
| AAATCTGAGCGGAG | TAGAACAAGATACA | AGATAGGTAAAAGC | CCGCTCGGGTAGTG |
| CCGCGTTCCCCAGA | ACTCGCGAGTAAAA | CCCACATCGCCACT | TCTCCAACAATAAC |
| AGAGTGCTCCCGAA | GCGGGTCACCCTCG | CTACCCTACCGCGG | GGATGTGCGGTCCA |
| CGCAGCGTCAGTCG | GCATCTGCGCGGCA | CGGAAAACGGTATA | AAAGAGTACAACTT |
| CGCGACTCTCGGCC | GTTCACAGGAAAGC | AGAGCGGTGGTCCA | GCTTATACACGAGG |
| ACTGTCGACCGGGC | CCCGTACATAGAAA | GGACCTAGCATGGG | AGATCAACTAGAAT |
| GGGGGTAAGACAAT | CCCGCAACCTGTAA | CGATAGGAAACATG | CGTGCTTGCGCAAA |
| CAAAACCTATGCAC | GCGTTACCCGCCGC | CGTCACACGTGGGA | CTCAAGTGCCCCTA |
| AAAAAGTTGCGCCG | GTAGCACGATGCGG | ACACGAGCCGAATT | GTGCAACGCTTGGG |
| AACCGGCTAGGTAC | CGGATAAAGAGCAT | TACATCAGGAGACG | TCCCACAGCATTGA |
| GGCCGTACAAGATG | AAGTACGCCTCCAA | CGGAACCGACGTCT | GAATAGACGATTCA |
| CGCACCTCAGTCGC | GGAAACGAGATTCA | GCAGGACTTCGGAC | ATGCCCAGCATTAG |
| AGTTCAGAGCGGGC | GGAGTGCTGGGCAA | TAGATAAGGAAAGA | CTAAGTCGGAATCG |
| GCAACTGACTGCCA | AACGGGGTGCGTCG | CATCGACAAACGAT | TCCAGTTAACCCGG |
| TAGGCGACACTAAG | GATAAGCCCTGGCA | CTCGTACGGCGGCC | ATAGGAGCGAATAT |
| CCTACTCGCCGAAG | GGGTGACTCACAGG | AAAAGTCAGCCTCA | TCGCCGTGCCTGGA |
| AGCGCAGATATACA | TGAGCTAGAAAAAA | ATCCAATAGGAATA | CACCGTCCGGTTGA |
| GGGGTAACGCTACC | CAGCCTGCCACATC | GAGGTGTAGTAACA | GTTCTCGACCAACG |
| CAGTCATACAGACA | TAATCAAACAAGCA | CGCTAAATCTGAAG | CTAATCCAACCGTC |
| GCTTCGCCACGCCA | CACGTGGGCAATGG | CTAAGCCGCTGAAT | AAATAACATGCACT |
| ACAGCGCGTCGGTG | GGCCTAGAGTCCAC | TCTCGTAAAGCGGA | GGATAGGGGTTAAA |
| GAGACAAATCCGTA | CCCTTCGGAGGGGG | ACGTCATGAGAATC | CACCTTGAGAATAC |
| GCCAGAACGGTTGG | AGCATAGAGATAGC | GATTAGAACCATGA | TGGACTAACTCGCA |
| CCCCACCTCGCTAC | CACAGAATATGGAC | TGAGTGAAGAGTAG | GCGAGTTGTGCGCA |
| TCAAGACTACGGCG | AAGTACCACCGTCG | CGCATTCAAAAAGT | GGCCATCGTGGGAT |
| GCGGAGTACCCTGC | TCAACTAAGAGGGC | TCAGAATACCTCGC | GCTGAGAATTGAGG |
| CCCATGTCGCAAGC | GGGGCAAGCATATG | CCAGGTAAGCATCT | GCAGATTTAAGACG |
| AGCCTCGGAAATCA | TGTAGCAAACCGCC | GTGCGGGTAGACGT | AGACATTCAAGTGG |
| GGCGAGATCGATAA | CCCAACGACATTAA | TGAACGCATGCTAG | TAACTTGACCAGCA |

FIG. 7 (Cont.)

| | | | |
|---|---|---|---|
| GCTTATAAACACCA | ATGGCGGATACCTG | CCTGTTAGGCGACA | AGAATATCCCTGGA |
| TGGCAGGTCCCCGT | CAAGATATCATCCG | AGACGCTATGAAAT | CCACAACCTACTCT |
| CGTGTAGCAATAAA | ATGCAGTGCGCTAC | GCCTGACAATCGGT | ATTCGCCCTAACAG |
| ATGAGACTAAGTAG | CAGCCGCTGATATG | CGTAAGCAAGATTA | GGATGCCACATCAT |
| GTTGAACCTGGGAA | CCCGTTCAGCATAG | AAGATGTCCAATAC | AGAGTAAATCACGT |
| ACGCGGATCATTCA | GACCAAGTTGGCTA | CCGTAGCTAAAAAT | ATAGTGTCAAGGGG |
| TAGGTCAGTGAGAA | CGCGGAACGCTTTC | ACCCCTGCAATACT | GACTTCGGAAGATC |
| TTTCCCCGGGCGGC | GGTTGGCCTGGCGG | AGCCAACCCCTATT | CATCTAACGCATGA |
| GACCGTTTGCGCAG | GCTATGATCGCCAA | GATGCTTAGGGACC | TAACTAGCACCAGT |
| TCGGGGACATCAGT | AGCGCTTTAGCACG | TACCAGTAGAAGTA | CTAAGCACCGCTTC |
| CATACCTTAGGACC | CTGCTCTGACGGAG | GGCAGCCGTTATAG | ACAGACTGATAGGT |
| GCACTCTGCAGTAC | TGGGGCATGCTCGG | GCTCGGCTTGCGGG | AAGTCAGCTCCTAA |
| GCCTAGCGTCGCTC | CTTGCCGGAACTCC | CGAGCCTCCTGCTG | GACTCCCACACATT |
| CTAACGGTGTAGCA | GCTGCACATCTCCC | TTGCCCACTGAGAC | GTACATGTACCGAA |
| CGCAAACGTTTCAA | CGAATTGCCCCAC | GGCCTAATGACCCT | GGTCGGCTAGTACA |
| GCAGGCGTGATGAT | CGGATGTAACCTGC | GTAGTATCGGAAAC | TGATGCGGACGGAT |
| TAACAAACAATGGT | CACCAATCGTGAGT | AGTTACGCAGTCCA | AAACAAGTAACTCT |
| TTCCACAAGGTCGG | ACAAGATAGTTAAA | CATCAAGATAGGGT | AAATTCCGACAGC |
| GAGCTCCCTACACT | TTCTGGGAAGCGGA | ATCCTAACCATAAA | GAATTGATAGGCCC |
| GTGCTACGAACGTC | CATGGAATAAACGT | GGCATAATACTCAC | CAACACAATGGATT |
| GTTCCCGCTACCAC | CTGTCAAGAACACT | TGGGCCTATCGGGC | CACTTGGAACGTAC |
| CCCCAATAGTCTCC | CAGATGGATCTACC | TAAGATGAAGCATG | GAGTTGACCTACCC |
| AGTAGGAAGATCGT | ACGAGATATGGTGC | CGTCAACCATTGAA | GGGCCACCTTATGC |
| GACGCCTTGCGCTA | TTACTGCGCACAAA | ACAGCATCGAGATT | TTGACCAAAATGGG |
| TCGATCCACGCAAT | GTCAATCTAAGAAA | GGTTAGCTGAAGAA | ACGGTGCGATAAAT |
| TGCTGCGAAGTCCG | GGGAGCGTGTGGAT | TAGTCCCAGTAAGA | CAGTGCATAGGGGT |
| TATCCATGACCAGA | TGACACATCTGCGG | ACGGGTGCCAATTG | GGCACGGTGCTCAT |
| GGAAGATTATCCCA | TTACCGCCACGTAG | GGCACATCGTTCAG | CAGTGAAGTCCCTG |
| TAACGGGCATTACA | AGTACATCCAGTCC | AGCAACCTACTATA | TTCCGGTGCAAAAG |
| CTGGGGAGCCTCTA | CTCAACGACGTCTC | GAGCCCATCTGTGG | GCGTCTGGACAACT |
| ACTAAATAGGGCTC | GAATCGCATGGGTC | GACAGTGTAGCTAC | CGGACCATCGGGTT |
| TTCCCGCAATCGAC | TGGACACGAGCCTT | CATACTGGCTGCGG | CATTTCAGCCGCAC |
| TGACCCCTAGCGT | CCTACGTTGGCAAG | GTCGGCTGAGGAAT | CATCGCGCTGATGA |
| ATGTCCAGGCGCTA | GTCACCGATTGCGA | AATGCGATCTGAGC | GTGATGGCCACGGT |
| CCAGATCCCCCTTG | CGGGTCCTAACATC | GTCGCAGACAAGTT | GATACGCGTGCTCA |
| CGTGGACGGTTAGA | TTGTCCGCACCACC | ATTGGCCCCCGCT | TCTGGTAGGCCCGC |
| TCCCTGGCTCGCAA | CCAGCCACTTCTGG | GCGTAGTTAACGCG | TCTAAGAAAATCGC |
| ATACACCGTATGAC | AGACATACCTGGTA | GGGTGCTAGGATAA | CGGACGGAGGTTCT |
| ACGATTACCACCTC | GCTAACCGTCGCAT | AACACTACTTAACG | GGCTCACCTCGTGG |
| AGTAATAGCATACA | TGTGGAAGCATGAG | TCCCACACCTCAGT | GATGTCATCAAAGG |
| GAAGGTCTGACTAC | CAGGCCTGTACCGT | TTCATCGAACAAAA | ATACGTCCAGAAGT |
| TGGCCAGGTGCTAA | TCTGTCCGAAGGAC | TCTAGCAGCGGCTC | CGCAGCTTAGCCTA |
| ATGTGGCGAATCCA | ACAACGTGCTGATG | CCTGCCCGTCATCC | ACGTAGGGTAGATA |

FIG. 7 (Cont.)

| | | | |
|---|---|---|---|
| GGCCTTCAGAGTCA | GTCACAGTTCAAAC | GAGTTGCCATCAAG | TGGGAACGTCAGGT |
| CCCACGCGTCAATT | CAGGGCGTTATAAC | TCAGCCCCTAGATG | GTGGGCGTGCAATC |
| CCATAGACGCGGTT | CCGGAATGCTCTAA | GTGTGCGGTACAAC | ACGCCACTTAGCTA |
| TTCACAAACACAAT | ACCTTCCAGACTAG | GGAGTGTGACATCA | GCCCTTGCAACGTA |
| AGCTATTCACCCAA | TCAAATCAACTACG | ATTGCGGCAATGCA | CTTACCACCTAGCC |
| TCGGGGTAAACATA | CAGTGGCTCTCGGC | CCCAGGTTTGAGCA | GTCTGCTAGCCAAC |
| CTGGGGCTGCTACG | TAGTGTCAAACACA | CTCCGACGATAAGT | CGGCGTCCCTGTAA |
| CGCTGATGTGGCAA | TGAGAAAATGCAGT | GATAGCAGTCTCAA | CGCCTGACTGCCAT |
| CGTCCCTGTCGCCC | TCAATCTAGAGGAA | CGCCTCCCGTGTAC | GGAGGGTCAAACTT |
| TTGAGAGTGACCCG | CGCCTGTGATCGCG | CAGCTACAGACATT | ACCGATTCTGGCCG |
| CAAGAATTACAAGT | ACTACTTAAAAGGA | TGATCTCGCGCCCG | ACTCGCACATTCGA |
| ATGACGGGTCGTCC | GCGATAATTCACAA | CAGCCTGGTCATAA | CCGCCTAGCTAAAT |
| TCTTGCAAACCCAA | ACGAAGGGTTACCT | TCCGATCGCCGCGT | TGTCTCCACACAAG |
| ATTGGAGTGGGCAG | GGGCAGAATAATGT | GCTAGCGGGTGCCT | GCGTGCTGCACTAG |
| ACGAGGTCGCTGGT | CCGGATCACTTAGG | TCAAAACGTTAAGG | CATTAACACACATG |
| GGCAGTACACCTAT | CTCCCAATGCTCCC | GCTGGCAGAATCTA | AGGCCCTTAATGCA |
| TCTCGGACGTAACC | GGGTTCAGGTCGAA | TCCTGGCGTCCGCA | CTGCACGCACTAAT |
| GCTGCTGTCCCCGG | CGTGCATACCGCAT | GTATAACCCAACCT | TCGAAATGCGGTAG |
| AGGTGGATACGCGT | CTCTCGCCACTAAC | GAAGTACCGGTATG | CCCAGACCTGCCTT |
| CGTCGTAGAGATAC | CCTTCGAGTGCCGC | CAAGCTACTGCATA | TGATATCGACAGGG |
| GTAACACGCCTCAT | GTTGGTGGACGACC | AGGCGGTCTGCCTG | TGTACAACGCACTC |
| CGAACTACGAACTT | CCCGTGGGTGACTA | ACACGGACGGTTAT | ATCATGATCAGCAA |
| TAAGCAAGTTCACG | GTAAACTGTCCCGC | CCAGTTAGCCGCTC | TGCTGACTCGGCGG |
| ACAGGTGCGCGTTA | ATGGAGGGGTTCAC | TAAAAATAGACCCT | ACACCTGGTCCATC |
| CACCTGCCTAAATA | ATGCGGCTCGGGGT | TCGTCAGACTACAA | TTAAGGCAAAAATC |
| CGCCAGCAGTGGTT | AGCGCGTACGCGTT | ACATCGGCTCGTGG | AATGTTACGCGGAC |
| GTGAGATACTCGGC | ACGAGCATGTGCTA | ACGCCGTTTGAAGC | TAAGATTACGGCAC |
| TGCCAGCTAAACTC | CCCGATTCATGAGC | CTCTGAGGAGCTCA | CAGAAAGATTATAC |
| CTGAACTCAGCTGC | CGACTTCGTCGGGC | GTCGGCGTCGTAGA | GGATTAGATAAGGC |
| ATTGTCCACGGAAG | CACCTATTAAAGGC | TAGCATTCCCAGAC | GCTTCGGGTCCGGG |
| ATCGTCGTAGGCGG | ACTGTGTGGCAGGA | GTAGTTCCCGGCCG | CGTACTGCTACAGG |
| CCTGGGCATCCGTA | TATGGAAATCACGC | TGCTGCACCCAATA | ATGGCCTGGAAATA |
| CGTCCAAGACCATT | CGATACCCCGTCGT | CAACCCCTTGACTC | TGACGGAATTAAAC |
| CGGGTCTTCCGCCA | GCGCGATGGAATTA | AGGTGTGGACTCAC | AGCCGTAGCTTAAA |
| GATGGTGAGAACTA | AGGGTTTAAAGGAA | ACGCCTCATAAGCT | AAGTCCGTCGCATC |
| CCATAACTAGGCTA | GGGTTGGTGCAAAA | GAGATCGATCCGAT | TGCCGAGTTCGAAC |
| TAGAAGGCTTCGAA | TAACACCCATGATG | CGGCTAGCGGGTGT | AGGCCTCAGATTGA |
| CACGAATGTGCACT | GCTAGGGCGATTAA | AGGCCCACTTCGA | AAAGTCGATGGAGT |
| GTAAACTGATACAG | AGGACAAATGTTAG | GTGCATAACACAGT | GGCCTACTTAGAGA |
| TGTCACATAAGGCA | CTTGAGGAGTCCAG | TTACGATGACGGGC | GCATCTAATCAGGG |
| CCCGTAACCTTGGC | CTCAGATCAAACAT | TTAGGACTCCCGGA | AAGATTCATAGAGG |
| AAAAGTGGCATTCC | TCGGCACGGGAGTT | AACACATGACGTAT | ACTTCACGCCGCGT |
| GACTGGATCATCAA | GCGACCAAGTTCCT | GCCTGATCGATGCC | GCGAGGACTTTGCA |

FIG. 7 (Cont.)

| | | | |
|---|---|---|---|
| TACCGATGTCCCCC | TGCTCACATCGGCA | AGCCTGGATCGATG | CTTGCCCATGAGAG |
| GAGAGTATAAACTG | CATGGCTAACGCGT | CCGTTCAGCCAAGT | AGCCTCTGCGTCCA |
| ACAAGTGCGTCTAG | CTGCATAGATGCGC | CCAATGGTCACATC | CTTATAACCCGGGA |
| GTCCTGAGAGTCAA | TCCGAGTGAGGCTG | GTGGAGCCATTCGG | GACTGCTTGGAGAG |
| GAATCGCTGTGACG | TGTCGACAGCGTAC | TGCCAGGGGAGCTT | GGTTCCCAAATACC |
| ATTAGGGAAGTAAA | CCCCTACACCCCTT | GATCCGCAAATTAG | CCTGCAGTGACAGT |
| GCCTAGTCAATCAA | CTGTCTAAGGAGCA | GTCTACACACATGA | CCAATCGCGAATTA |
| ATGCGTACAGTGCA | CACCGTCATGTGAC | GGGCATATAATGGC | CGGCCATAATGTCA |
| AATAAGTGATGAAC | TTCCGCACTAGACC | ATCCGTAACGATAG | ACTAACCTGGGATA |
| TAACACTACTAAGA | CCAGATGTCGATCG | ACACATTTACCCGG | AATGCACTTCGGAA |
| GAGGACTGTAGATG | TTATGCAGCAGCAG | GTCCTGTCCCAAAC | GAGTGAGCCATGTG |
| ATACTAAATGCAGG | GTGGACAAACTCTC | GAGCCTGATGCGTC | CTCACCGTATCCAC |
| CGACTTAAAAACTC | GCCACCTCAATGTA | AATGTTCGCAGGGC | AAACGCTCATGTGA |
| TTAACCCAGGTAAC | CTTCGAGACGTGCG | TCGCTTCCGGGAAA | AGCTAATAAGCGTG |
| CCGCTAATAATAGC | GACTAACCGATAGT | GTTAGGGAGGCGGT | TGAAAAGGGTGTGA |
| CCGGCAATGGGTGT | GAGTCAAAACTTCC | AGGTGCTCGATGGC | AAGATTAACCTGAG |
| CGTTAAAGTAAACG | CGTAAGTGCCGAAT | CGGCTATCACTACA | GGCAACTTCATACC |
| GCCTAAGCTACGAT | GTAAGCTCTAAACG | CGCTCGAGCGTATC | GCTGCACGTACACT |
| ACAGCGGCTATATC | CGAAAATGGTATAG | ACCTCACATACATC | TCGTGGGATCACCC |
| TGATAACAGTCGAC | GGGATTGCTAGCGC | GGGACCGTCCGTTA | GAACGGATCGTGTG |
| AGGGCTCTCTCCAG | ACTCAAGAATCAGT | GGGTGCGCCTCAGT | GACCTCATTGACCG |
| CAGGGAGGAGTCTT | CGCCGAAAGTGTAT | GGGTCCAATCCTAG | GAGCGTGTGACGTG |
| GCGATGTCCGACTG | CGCGTTACTACAAG | GTGATCGTACGGGA | CCAGAGAATATGGT |
| GAGCCTCCTCTAAA | TATGGTAAGGGCCG | CAAGCAGGTATCCT | GTCAAGATGCAGAT |
| ATGAGTAAGCTAAC | TCTGACTGCGCCGA | TCCCTCCCTAAGC | TCTCGTGGGACAAG |
| CACAAGGCAATCTT | CCAGTGCTATGAAG | TCCAGAGACTTGCG | AGTTGCGACAGAA |
| TCAATCCCCCACTA | ACCTACAAGCATTC | TCGGTGGATGCCAA | AGCAAGCTGGGCTT |
| CGAATTCTCGGACG | GGATTATAACCGCA | GCTAGCTCGGTAAC | AATTAGGGTAACCG |
| GGACTCCTTGGGCG | TCCTAAAGAGCTGG | CAGAGGCTTGACTG | TTTGGACGGAGGCG |
| CAAATTAGGCCTAG | GCTAAATGAATCAG | AAGGTGGCCTTACG | CCTTGAGACAGTAG |
| CCATCAGTCTGCGA | CTAAACCTCCCCAT | TCAGGTACCTGCGG | ACACTAGTTGGAGA |
| CCATTTGGGAAAGC | ATGATGACGTAACA | AATACTAAGTGAGA | TCGCGTCTAAACGG |
| GGAGTAAAGCTGTA | TCGGCGAAGTCTAG | TAGGAGTAGCCACT | CTCGAGCTATACCG |
| CCTCCCGAAATTGC | GCACCTCTTCCGCG | GATCCCTGGAACAT | GGAGGATAATTAAG |
| TGAGAGGACCTGTA | TACAATGGCGGTAC | ATGCTATGCCCACA | AAGGTTCCTGCCAG |
| ATACGCTGCCGCTC | CGTACTCTGCACAG | CAACAGCGATTGCT | AAACTATGCATAGG |
| TCACCCGATTCACA | AGGATCCGATCTCA | GCAGTTAGGATCAA | TCGCCCATAAAGGT |
| AGCTAGCCTGGGTA | CCCGTCCCTACCTC | GTCATGGCCCTGCC | AGTGGCTGGTACCG |
| AATAGCGATCCATG | CGGTATCTAAGCGA | TAGAATGGGTCAAC | TGGCGTAAGAGATA |
| ATCCCGCATGAATG | CACGTTCCACACTC | GGGCGATTCGGTAC | CTTAGCACATCCCG |
| GTCAATGCTCGGAC | CGGATTCCCCACTG | CAGACTACTAGCTC | CAAATGCCGGTTAG |
| CGATACGTGTCCAA | CCCCTCAACCTGTA | CCGTCAATAGTCCG | CCACCTGACTCTGG |
| CAGTATGTGGGGGC | CAAGGTACATGGTC | GCCAAGCCGTAATT | CTGCTTAACCGGCA |

FIG. 7 (Cont.)

| | | | |
|---|---|---|---|
| ACATTGGCGAAGTC | ACGCATAGTCTGAA | ACACCAATTACCAT | TGGGTGGTAGACGC |
| TAAAGATCCTACGA | TCGTTGAAAAACAA | GCCTCGGTCCATAA | TCCGCTTAGACGCC |
| CTATTAAGACCGAA | GCGAGGAGTTAAGT | AGGAACCCATCATT | GCGATTCGCCTCAC |
| ACGTCCATCGATGG | CGAAGTGATCGGTA | GGCGTCCCGATTAG | CGGCCTACTTCACC |
| TCAATAATCGAAGG | TCTGCGCAGCCGCT | TTCAATCACACGAG | ATCGGTCACTCACA |
| GTCCATATCGCCCG | GAGCACTGATCAGT | CACCCCTTACCTAG | CCACACTTGGTAGA |
| GACTTCACATGGGC | GCACGTGGAGTGGT | TACGGTCCACTGAG | TCCAGACTGACATA |
| CACGGGTGTTCGAA | GACCTCTAGCCACT | AGCCGACACTACTT | CGGAGCAGTTCTCC |
| AAGTTCTCGGCAAC | TCGATTGCCAGCAA | CGGCTAAGTGTACG | ACGTACGTCTCGGC |
| GCGGTAGTATACCC | CCTTAAAAAGTACA | GATGTGCGCTCGCG | GATGATGGGTCGAA |
| GTAAGTGACAAATA | GTCAAGGAGTTACG | GACCTCTTAAACAA | CACCCGTACAGATT |
| CATTAGAGGTCCGG | AAATGGCATCTCCC | GCCCTATACGTGCA | AGATAGTCTGCGGC |
| CACTGCCATTCGCA | CAGGTTGCAGTAGC | GCCCTTATAAGGAG | TTCACCCAATGAGC |
| GCACCGTCCTAATC | CGAATTACACCTCA | CCTCAAAATGTGAC | GCACCGAATATTAC |
| CCTGTGCCACGGGT | GCTGCAGGGCTGTA | GAGAATTCCTGGGG | GGAACCCCGTTCTA |
| AAGAGCGCTGCTTA | CGCCCTCTCAAATA | GCCATTACTGGGCG | CACTAGGACGGTTG |
| GTGGGCATACCGAT | CCGTTAGGATCACC | GGTCCCTAGGCGCT | CAGCCCCAATTTGA |
| CTTTCCCACCACGC | TCCGGGATGATCGA | AATGACTATCGCCG | TTAATGACCCAAGA |
| ATTCGTGAAAAAG | ACGTATAGGTGAGC | AGTACCGGGTTAGC | ACCCACATTCAATG |
| AAGACTTGGCCTGC | TCCACCAGGTCGAT | CCGTCCAGATTAAA | GGCGAATAGGCTAT |
| ATGTGCACGCAACT | CCAACCCTTTAGAA | TGCGCCATCTAGAA | CAAGTCCCACTTGA |
| AATAATGCTCACCA | ATAGTAGGACTGAC | TCCAGCGCTGGAAT | CGATCGGTTGCGCC |
| GCACAGTTAGGCCT | AGCGCATCTCCAGT | CGTGACGTAGGCGT | GTGTAACAGTGCCA |
| AAAATCTACATGCG | CTTACAAAGACTAA | GTATATCAGCCAGA | TCGCGCAACTTGGC |
| AAGAAATGGTGTCC | GATGCACCTGCCTC | GGTAGGCAGTGACT | TAGGTCCCGTCCAC |
| ACACGCCAGCGTTT | AGGGAGCCCTTGCT | GTCCTTAAGCCGCC | TTCCGTGGAGGGAC |
| CTGAAATTCGCGCA | TAGATGCATCCCGA | CATGGGCGATGCTG | GCTTGCCAGGAGCT |
| CGATCAGATCCAGT | AGCGTGTTCACGCG | GGTCCAAATGCATG | AATCCTATCGCGCG |
| AGGTGAAATCGTCC | AGTTCGACCGGCTC | TAACGACCTTCGAA | GGGTCCTAATCCCA |
| TAGAAAGGAGAATT | CCAAGCGCTTTGAG | TCGGTAAGCTACGC | TCTACAGGGTAAAG |
| AGCCCGTTGGATAC | AGGACGGCTTGATC | GGAATTCCATCGGC | AATGCCCAGTGCTA |
| CCGTCTACCTGCCC | TCACTAAGAAATAA | ATCAGTGTGGAGGA | AGCCCTTGACCGGT |
| CAAGAGTTTCCGGG | CGCTGGATGACGTG | GGCGGTGCCATTAC | AGTGGTCACATACC |
| GATCGCTGAAGTCG | TACGAGCTGCCTAG | GCCTTCAAACTAGA | CTGAGGAAATCGTA |
| GCGGTCAAGGGTTA | CGCTCCGGTATGGG | CCTTGCGTGCAGGC | CCCGCTCGGTAGTC |
| ACACTTTGGAGGGG | CTCGCCTATAGCCC | CGTTACTGGCCACG | CACGCGAACTCTGT |
| TAGCATAGAACGCT | GGAGGCTCTCTCCG | GTGTACAAGTAGCC | CCAACTGAGATGTA |
| GACCGTAGTAAGCT | AAAGTGCAAATTAC | TTCGGCTGGGCCGG | GGCGAGTGCGTAGT |
| TACGGGGTTAGAGG | TAAAGACTAGGTGA | ACGCGAGTCATCTG | AGAGATAATTGACG |
| GCACCTAGGCGGTT | GACAACCAATTCTA | GTACACGTGGCTAG | GCCATCCTAGTACA |
| AAACCGTACCGTTA | GCAGCCTGAGGCTT | TACCCTGATGAGAA | CCGGCTATTCGCCG |
| CGGGGTGTACCTAC | GGTAGAAAATATGC | CCTGGCCTGGAGTA | CAGGTGGGGTCCCT |
| GGCGCATTTCCGAA | ATCTACGAGATCGC | AGCGAGGATCACTT | TACAACTAACCTCA |

FIG. 7 (Cont.)

| | | | |
|---|---|---|---|
| GGGGTGGGCAATCT | GATTTCGCACACCA | TCTGCCGTCGGCAC | TGGGAGATTGGGCG |
| TCGCGGTCTACGAC | ATGTTGAAGGGCCA | CTAGAGATAATAAA | TACCAATAACGAAT |
| TCCCAACTATAACG | TTACAGCGCGAAGT | CCGTGCGATGTGCC | GATGGAAGGCTGCT |
| TGTCACACGCCATC | TATGAGCCTACCAA | AGATCGCCATTACG | GAACCTCTCGAAAT |
| AGTGCTCAAGAGGT | TCAGGTGGCTCGAA | TGTCAGCGGGTCAG | ATGTGAACAACCTG |
| TCCCGGAGTAGATG | ACCTAATACGGCGT | GCTTCCAGCAATAC | CCCGGATTCAGGTG |
| AGCTCCCGTAGGTC | GGCCAGAAATCTTG | GCTTAAGAGGCTAG | AAACCCCAGGTTCT |
| CCTGCCTCGCTAGG | GTCGTATGCGCGAA | CTTTGCGCCGCGGA | CGGCCTGACTACTC |
| TTTCCCAAGCGCCA | CAGCTAGGTGTGGC | TAGAAGTGACACTA | GGCTTCGGGGTCAC |
| TCCACAGTGCGTCG | GACCTGGCCTATG | TCGAGTACGGTGGC | AACGATTCCGAATC |
| ACGGCTGGTTGGAG | AAAGGATAGTCTGC | GGTACATCCGCTAG | TGGTACGATAGAAC |
| GCTCCAAGATCTGG | TGAGGCAGGTCGTA | GCGCTAAAGTCCGT | GAATCCTAGATCCG |
| ACCGAATGACAATT | CCCGTTTGCACGGC | CGTCTCCATCGGAG | AGAACCATTTAGGG |
| TAGAGCAAACAGTT | GCTACCAAGTGATC | CCCTACCAATGAGT | GTACGATAACCTAA |
| GGGGTCGTCGTGAA | AGTGCTGTAAGCCG | CCACCGCTCTGCAT | GCGTAAATGCAATG |
| GGGGGACCAGATTT | GCGACTGATCTGCC | CCTCACCAGGCTCT | TAGCTAAATACAAA |
| TCAGTCACAGTGCA | CCGCGTTACTCGAC | GTATTCACGAAACA | CCGCGTTACCTCCG |
| CCTTCCGTAGCCGG | GGGTGGAGTATGAA | TTGCTAAAGAGCCC | CCGGTACAGTGTCA |
| CGTACTCCCACTCA | TCCAAACGCATTCC | GCGACCGTACTGAT | TTCAAACGACAAAT |
| GTAGGCTGAACGTA | CCCTCAAGCCTCTG | CGCTCGCTAGGATA | TGCGGTTGACAGGA |
| GCCTAGACCTTACG | CTTCGCCTAAGCCC | GACCATGTTGCAAG | ACTCCCTAAAAAAT |
| AACAATCATCCTAG | ATCCTAGCGGGCTG | CCGTCTGCGCCAGT | CCGGTGAGCTCTCG |
| TATCTACCCGGCGG | AGACGGCTTGAATC | CATCCCGATTACAC | TCGAGATCCAATGC |
| GGGGAGCCTCTTAC | TCCGTAGCGTCCGG | GATGAAAGAGGTGT | AACGCGTGTCGGGT |
| AAAGAACCGACTTT | CGAACCCGTCCTAT | GGTACTAATCCCGA | CCGACCTTGATCGC |
| TAGAGTCTGGAAGA | CTAGTTCGACCCGG | AACGTTCCTAAGGA | GGCTGCTATACGCC |
| GTTAGACTAGAGCC | ATCCATTGCACGAA | AACGGGTGGAGTAT | AGACCTCGAATGCT |
| ATCGTCCAGCGCCT | ACAGTCATAACTAA | GGAGTATGCGCTGG | ATGGAGACAGGTGT |
| CGGGCATCATCATC | CTTAGCTGCGACGG | ATCCTTCCGAACGG | CCTTGACGTGCGAA |
| ATATGGAAGAATGC | TAATTAACCCAGGG | CCCTCGCTCACGTA | CGCCGTCTTCCGGG |
| CTGTGAGGGTGGAC | CACGATACAGTGCT | ATACTTAAGGGCAC | CGATACACGTATCA |
| TGGAGTTACAGGGC | ACTGCTGGAATCAA | TCGTACCAAATGAG | CAGGAACTTGAGAT |
| GGCCAGGTTCCACT | TGTAGGGCCTGGGA | CCCCAAAGGAATTT | GAGGTTAGCGTGCG |
| AGGAGATGTCCATA | CGGTCACCTACGTA | GATCCGTTAAGGAA | CAGTACGGCTACCT |
| GCTCGTGATGAAAC | AAAGCGCTCTATCG | TAGGCGACCCCGTT | AACCAGGCTCTCTG |
| GCACGCGATTGTAG | CTATGAGAAGTCCC | TTTACGCACGGACG | AAGTCAAACATAGT |
| ACACCAACACATTT | AACCACCAGCTTTG | TGGTTGCAGACAAC | GCAGACTTTCAGCA |
| GCGAGCCTCCCTTC | AGTCTACAGCCATA | AAGAGGTATCGTAA | GTAGCTCAGAATGA |
| GTTCGTCACCCCGC | CAAATAACTCTACA | ACCCGTGGGAAGTT | GAATAACTATCGCC |
| ATACCCCGTACATG | CAATGCCCACTGAT | CACACGCCCTTGTG | TCAAGTAGGCCGCT |
| CGTCCCTCGTCGAG | AGCTCCATCCCGT | ACACAACTGGGTTG | AGGCATGGTCGACT |
| ATAAAACACCCTTC | TAGCAGATAGAGTC | ACCAAATCAATTGA | CAACGTGTAGCATC |
| CATTTGCCGCAACA | CCAGTTTAGAGCCA | CGTGCCTACGAGTA | CGTGGGTACTCACC |

FIG. 7 (Cont.)

| | | | |
|---|---|---|---|
| CAACTTTAACAAAC | TGTCTAACCGCCAA | TACCACCCCAAATT | ATCTTGCAGGGAAC |
| CGGTGCTGCCATGC | GCTAGAAATATGGC | ATGGTCCCAGTGAC | CGGAATCATGCTAC |
| ATGCGCATTCGGAG | CTCGAAACCATTAC | GAATCCTGGTCCAC | ATTCGACAATCGCC |
| CACGAATACATTGA | ACTGGATGGATCGC | TGCAGGTCATCGAG | GATTTCGCAGCAGG |
| AACGTCACTCAGTG | CAGATAGTCAAACT | TAGATATCGCCGGC | TTGGCAGGCGGATG |
| AAATTGCAACGGTG | ATGAGGAATTGCAG | CAGCCGTCGCTAAT | ATGTCCCACGATCC |
| GACGACGAACTTCT | GCTATGGCTCACAC | TTGCGGGAGAATGG | TCGAACGATCCCTC |
| ACGTGCCTGTGAAC | GGAAATGTCATCAA | ACGCGTAGTCACGT | GCGGACACACTTAT |
| TCCGCAGCTGCGCT | CGCATTCGAGCGTC | CGCGACTCACTCAT | ACTATTGGCGCGGG |
| AGAGGTTATACGCA | CCCGTGGTGCTCAC | CTACGTAGGTGACA | GGATCCACATATGG |
| AACAAAAATAGCTT | AAAGTACTCCCACT | CTCGCATCGCGGTA | CAGTTGGCACTAAA |
| TGGGAGATAGTCAA | ATTAACTGGAGAAA | CGCTTACACAACTC | TCGCCTGCGCTAAG |
| ATGCGCGATTCACC | AACTCACACATTCA | TAGCGGAGGCTACT | TCGCCGAGCGTTAC |
| GTATAGGGCTCCCG | GCACTTAACGGGCT | AGATTGGACCCTCA | TTGAACAAAACATC |
| GACCAGGCGTATTG | AGGGTGCTAGGGTA | GCCATACCATACTC | CCGTCGGCTTACGA |
| ACCAACCTCGCGTT | ACCGCTGTCGTAGC | GTCCGGCACTATGA | GTTCAAACATAAGG |
| AACAAGTAGTGCTA | TCATATACAAGGCG | CTAAGGTTCAAGGA | ACTGCAACCTGGCT |
| TGTAACAACACTAA | GAAAAGACTCCCTT | TACGAGACGTCATG | GCGGTCGGCCTTGA |
| TGAGTCGAGGCATA | CAGATGTACGGTGA | GTATCAGTCAAACG | AAACACTAGGTGTC |
| CCGACAAGCTTGGT | TGAGTGGACACCGT | GTAGCATGAGTACA | GCGGTTAGTCAAGC |
| CGTTAAGCCGGTGG | TAAAACAGGGGTCT | GGAACGATCTCCCT | TGCGAACATTAAAA |
| CTCCCACAAGCATT | AGACCGTTATCCGC | CGCGGATTCGCGGT | TAAAGAAGATGTCC |
| GGGTTAAGAGGTGC | AGCTATCAAAATAA | CACGTCAAATTCAC | GGTGGCGAATGCTA |
| GAGCCCGTTTCCCG | TTGCGCCACACCTC | CACATACTCAGATC | CACGTCTGGGTCCC |
| ACCGACGTAATGGT | GATAAACGGCGTTC | ACCCTTGAACTGAC | GACGCGCTTGAATA |
| AGGCAATTGACCGT | GTAGTGGGCCAAGT | AAAATGCGCGTGGT | AGTCGGCTCTCCGG |
| ATCTACCCCTGAGG | TGGCACTAACACCT | GTTAAGACGTCCGA | GAGCTTACTAAAGA |
| GTTGAACTGCGAGA | GTCAAACGCTGTC | CGATGTCGCTACGC | ATGGCTAGTGCGCG |
| GGATCGTCATGAGC | GGGTTACGCACCAT | GATGACGGAATTGA | ACTACAGGCGCATT |
| TGAAACCATGGGAT | TACTGGAGGAGTGA | CGCTCAGTTAACCC | TACGAGGTACTGCA |
| AGACCGCGTCGTGT | GACGAACGAGTTTG | GCCGCTGATGAACT | TGTGCCGAATCGAG |
| TAGCGAGCTGCCGT | AGCCGAATTGGTAA | TCATAAGACCGTCC | GTACCGATGGGCTG |
| ATAAGGTACACGTC | CCGAGCCACTTCTC | GTGACGCAGAGTTC | GTCCAGTACTCCCA |
| GCGGCACCACTATT | GTGCCACCTAGGCT | GGTGAGCACTCCGT | AGGCGACTACAGTT |
| TTGGTGGGAGAAC | TGATAGTGAGGAGG | AATAAGGTACTCAG | ATCAGGGTGCGCTC |
| GCTCTCTAAAGGGA | GTACTGCCGGTGCA | GTGATGTAGCGCAA | GGAAATTGAAGCGT |
| CTGTACGTAAAAGG | GAGATTTAGCAAGC | GCTGGCTTCAAGGA | GAGATAAGGCTAAT |
| AGCTCCCGAATCGT | TAACCACGTAAACT | CAAATAAGTCAGGT | TTTAGAGCCGACCG |
| AATGTACCCGAGTC | GGTCCCCGATGCGT | AAAGGGGACCTTCT | GTTCGCGACCGGGT |
| GCTTCGTCGCCCAG | GTGAGGAGATTACC | CGACCTTAGGTACC | CATCGTGGAAGAGT |
| GTAGAAGACTGGTG | GCTTAGGGACAAA | CCCGGTAGCGATTG | AAGTAGTTGCCGCA |
| CCACATGAGATTCC | CTCAAAGGTAAGGT | GTGACTGGGCGGAT | ATGGCTGCATAAGC |
| CATCTTGCGCCCAC | GGGACTAGTGGGTC | CTCCGCATACGCAT | GATGGGGCTATACA |

FIG. 7 (Cont.)

| | | | |
|---|---|---|---|
| GCCATAATCTGCGC | GAGGCTCGTAAGAT | AAGGCTAAATCTAA | AGGATCTTCGGCAC |
| CGGCCTCGATGGTA | TGGGCTGCGGGAGT | CTCAGCTCGCTAGA | CTACCTCCGCTCAG |
| GGTCGTGCGTGGAC | CCTGTACGACCTAC | CTGTGCTACCGAAA | CGATGATTGACGCA |
| GACTGCCTCGTAAC | CCTCGGACATGGTG | CACCAGTATCGTAG | AACTAAACTCGACT |
| CGCCTATAAACCTG | CTTACTGAAACGAG | TTGGCAGGTACGGG | GACTCGTCCCTCAC |
| TGACCCTGATCGAC | GCTGGGACTAGTAC | TATACATACCGGGG | GGTCACAGAGAATT |
| ACTCTCGCCGAGTG | CTCCATCACTCCGG | GAGATGGTGGGAGT | CGGGATACACTGTG |
| CGGTTTCAACCGGG | GTGGGAGTATAAGG | TCCTTCAGGAAAAC | TCGCCAACGTATCA |
| TTGAACGAGAAGGT | AAAGCGTAGGTCAT | CAGACGTCGTTGGA | TTAGGCCGAACTGC |
| GACGGCTATACAAT | TAAAGTGGGACCAT | GATACTATGACGAC | TCACAAGGTAGGCT |
| TTGCTGGCGCCGAG | CGACTCTAGGGGAT | CGCTGCTCTCCGAG | TACCGGCAACTTAA |
| ACACTGGCTTGACC | ACGGCTCTATGACC | CAATGGAAAGAATT | ACAGCTTAATCAGG |
| ACTGCACTCACTAA | TTCGCCTCCCCGGC | ACATGAAATCTCAG | AGTCTAAAGTAAAC |
| AATGCTAGGTAGGG | ACTCCTAGCGATAA | TCCCTGCCCACGCT | CCCCGTGCCCTTCC |
| AATAACGATTGGAG | CTGTCGACCCCTAC | CGGATACCTACTGG | TTAGAAACGCCATA |
| CGCATGTGAGGCGT | CCATGGATCGAGCT | GCACTAGGTATCGC | GCACATACATAAAT |
| GCCGAGGTCGCTCT | GGCGTGCTCAAAAT | CACAGATACTAATA | TATCCGCGTGCAGG |
| ACTCCAGTTCCAGG | CGGCATGATCCCTG | ATTCCTCAGCAGGC | CCGCGTCCGTACTG |
| CATCATGGGCTGAG | TGAATAGCGGTAAG | TATTCGGCGAGAAC | TGAGAATCCTAAGG |
| GATAGACATTAACC | CATTGAGGCAAGGT | TCACCACGCAATTG | TCGACATATCCAGC |
| TGGTGGACTCCACA | ACATTCGAGCGGTA | AGGGGCTTCTAGCA | GTTCTCCGGAGGCC |
| CAGCACCAATCCTT | ATAGCAGGATAACT | GAGGATATGGCTAA | GGACGGATACGGTT |
| GACTTAAGCGTGGC | GACAGACACCTTTG | GTCAGGCGTCATGC | AGATCACACAGTTG |
| ACCTACGAAGGGTT | ATTGCAGTAAAAAA | TGCCGGTCCCTGCG | GGGGGTTTCGGAGG |
| ACCTATAGTGAGAG | CGCATCTTGAGCCC | CCGCTGCATTCAGC | CACAGCTAATTAGG |
| CTCTGCGAGTCCCG | CTATGCAGCTACCA | AAAAGCTTGTAGCG | CGAATGACCGTGTG |
| TCAAGACATTGGGA | GTAGTGCTCAGCGC | GATGGGCTGGTAAG | TACCTGTCAGGAGG |
| ACCCTGGCCGTATC | AAACGAGGTATGTG | CACAGGCAAATTCT | TGACCGTCAGACGT |
| GTGAGTCAGTCCCG | AAAGAGGGGTGTTG | TTGACAATACAACC | GCGGAATTCATGAA |
| AAGACCCGTAGCTT | ACCTTTGCGGGGGC | GCGGATTGGTGAAA | CTGGACCCCTCTAC |
| GAGATTGCGTCCAA | ATTGCACGACATGA | ATGTGCCCGTCGGA | ATGGGGACCGCATT |
| CGAGGTTGTGAGGG | CTTGGCCATCGAGG | GACCTTTGGACAAA | TAACTCGTCGAGGG |
| AGGTAACCACTTCA | ACCTTAACTACCAG | AACGATCCATCTCG | CCTGGGGAGTATGC |
| GGTAGTCATAGCCC | CCTGAATTCCAGAC | CAGGCGATTGCAAT | AGGTCCTCGCCTCG |
| GGGGCTAGATTAGC | GTATGACATAAAAC | CGAGTCATCGATGG | GTTACGCGACAGTA |
| TGCAGATTGCCGGG | GATAGTAACCCGTC | TGGAGGCACTGGAT | TAGGCAGGTCTCAC |
| ACAATGTTGCGAGA | ACCCTGAGCTTCCG | ATCAAAGTAGTCCA | TTCAAGACGTCGCC |
| ACTAGACATACAAT | CACGAATGATTCGG | TTGAAGTGAAGGCC | GGAATCGAAGTGTA |
| GACTCTAGATAGAG | CACTTCCTCCCGGG | GTGCTACATCGAAC | ACAGCGTCGCCTAT |
| GACAAATGAAAGTT | AGACCTGGGTGGTC | GCGGTAGCCCCTTG | GCTAGGAATACTCG |
| CAAAGAGTGATAAT | TAAACTCGGCTCC | GTTCTGAAACCGGA | GGCATAGGGGCCTT |
| CATCGTATCGGCAA | CATCGCGAGCTTCC | TTAAGGAACATCAA | AGCTTTAACGAGCG |
| CCGCCACTCTGTGC | CAGAATGGACCCTT | CACCTGCCAGTACT | CGGTCGCATACACT |

FIG. 7 (Cont.)

| | | | |
|---|---|---|---|
| GGCGACGTCCAATT | CAGAATAGCTTCAA | GGCCTGGGACTTAC | AGTGCTTGGAAGAC |
| CGAGGCCTCCATAT | TTCGACCGCGTAAG | GTAAGACCGTGGAT | GTAATGATAGAGGG |
| CCCTGTACGTCCAA | AGGTGAGCGTGATG | AGGAGACAGGTTGT | GTCACGCCTATGAC |
| CGTACCTAAACGTC | AAGCCATGCCCGTT | CAGAGTGCTCATCC | GAAGCCTGTTCGGG |
| GGTGAGCGCACTTG | TACCTCGTGCCCGA | AGACTCCGTACCCT | CTGCGCTCGTGGCG |
| CTTATGCGCCAGAG | ACAGCTAAATAGTC | AGATTGCCCCAATC | AGATGTCCTGCGCG |
| ATCGAACGCTATAA | GGATCGAATATCGG | GGAACGGACTGGTT | AAACCAACCTTACT |
| CGGTGATAGTCGAG | AGTTACTGGGACGA | CCCAGCTACTGACT | AGCGATGTATCCGA |
| TCCCCACTGGGTAC | ATCATCAGAGTAGA | TTCTCCCACGAGGA | AGAGCTCCCGTCTC |
| TGAATCACTAGACA | GGAAAAATCAGTGT | CCTCAGAGGTTAAC | AATTGCCTACCCCC |
| AAACGTCGCTCTAA | GGTCCCAGCCTCAT | ACTTCATGCGCCAA | AATGCAAGGTCTCA |
| TAGAGAGTCATCGA | AACTGTTAACGACC | TCGACTAGCAACGT | TAATCAGGCTACCG |
| AGTGGTCGTGCCAA | TGAAAAGTCGACGT | GTTAGAAGATAGAG | GGAGAAAGTTTCGC |
| ATACCGGGTGTGGG | CAAACTTGAATCCA | CTGACTGCCAGAGT | CAGGGTTGATGCAA |
| CCAGTAGCCCATGT | GCTTCGCCAGTAGG | TTACTAGGGCGACC | TATAAGCAAACAAT |
| GTCCCGGAAATTGA | GTGGCCTCGCCTAA | GTGCCATCCGCCTG | GGCAGGTTACAGTA |
| AAGTGGAGGCTGTA | AAGTGTCCGCGTGA | CATAACCTCGATAG | GGGAGGTGACCTCT |
| GTAGAGTAGATAGC | TCACCGCCAATAGT | TCTAAAAACGCTCG | CGGTGAACTTACCG |
| GTCAGCTGCGCCCT | ATTACGACGCATGG | ACCTTAAGCCGGCT | ATCGATCTCAGACG |
| ACGTTCTAACGCAG | GCCACACTAATGGT | ACCGCGTAGACTTA | CACCCTGCCCTAGT |
| CGGACCCCACTTTC | AATCTCGGTGCCGG | ATAGAGTTAGACGG | AACGTCTACCGGTA |
| GGCTTGAGATGAAG | AAATATGCAGGTCG | TTCGCCAGACTACG | CGTTAAGCCAAGTC |
| CGTTACTACGACCC | ATGAAATAGATGGG | ACCGTACTTCGGCG | CGATGCATCTCAGG |
| TGCGTGGCAGGACT | TGCCGAGACCATTC | TATACCCAACTCAC | GTAGCGGAGCTCCT |
| TCATGGCTCAGCAA | CAATTCAGAAGTAA | TATCACCATACCCC | TCCAACCGAAGTAT |
| GCCGTCAACCTCAT | GACGTTCTGAGGCG | TGGGCCTAGCAATG | GACGTTATGGCGGC |
| TCTCCGTAAGGCAG | AATAGCCTTAGGCC | CAATAGTGCGCGCT | GCGGTCTAGCGGCT |
| CCGTGCCGCAACTT | GCGCACATAGGTGT | AACTACTGGGATCC | CGGCAGTGTCGTCA |
| GTTACATGCACGGA | GCCCTGATTGGGGA | AATTAGGGACGGGT | TAATAACCGGAGTG |
| GACGAGTAGATGAT | AGTTCCGTGGCCAC | GGATTCAGAGCGTC | TGTCCGGGTCCAAC |
| TAGGTAAAGCCGAT | AAACCAGTTTCCGA | GTGGCTCGAAAATC | CTCAAATCGCCTGG |
| AATATGGCTACGGG | AGTCGCGTTACACA | CACTCACGACTGGT | TACGACTAACAATC |
| GTGGCGTCGGTCGA | CGTCGGGAGGTGTC | CTTATGGGCAGGCA | GTAGCTGGGAGGTG |
| GCATGACTCAGGCT | TGATAAACCCTGCA | CGACTTACGGCACT | CCCGTTGTCAAACC |
| CGTGACCAGACTTC | ACTGCAAGCTTAGG | CTACACACGATTGC | CCGGACGATCTTCG |
| AACTACTCAAACTG | CAAATAGCATATAA | ATCGTACACACAGT | GAGCTACTTGCGAG |
| TAGGGACGATGAGT | CTGGCCGTACCTGA | AGGTAAGGGCAGTT | GTATCGAATCCCAC |
| TGGATAATAGCAAA | GATATTGACGGGAC | TCGCGAGCCTGGGT | TCGTGGACGCGTGC |
| TGGATCTCAAGAAG | GATATCAAAAGTGC | AGCCGTCCGACCTT | TAAACCTACACATC |
| GGGTATCAGTAGGG | CCCTAATTCGCCCG | AGACCGGTATGGAT | CGATGATGAAGGGT |
| TCACCTCGCATGAA | GGATATGGAAAATA | AGTAAACAACTCTC | ATAATGCTAGGAAA |
| CATGGGACGGGTAT | AGCGCCTACCTACT | CAAACGCCTTCATC | TAGGATCCGTACGG |
| AGAGTTGAGCTCCC | TTGAAGCATGGGGA | CGACCCAGTCACTT | TGCCGCTGACCTGG |

FIG. 7 (Cont.)

| | | | |
|---|---|---|---|
| CACCAAATTCAGCT | CTAACAGTTACAAA | CACCAGATACTGTG | TACCCGTGGCGTGC |
| TGATCCCCACTCCC | ACTACACTAAAATG | CTTGACGCTCGGAG | CACAGTTACCCGCT |
| ATATCCATCAGAGG | GTGGACAGTCCTGA | TAAGCGGGATGTAA | TGTCTAGAGAGCAG |
| CAATCCAGTCCTCA | TTAGTCAGACCGCC | CAGCTAGGTTAAAG | AGATTCACAGTCGG |
| AGTGTACGCCGGTG | CAGAATTAGACATA | CAAAACGATTTGCC | GATGAACTCCAATG |
| TGGACCTGCCCTAA | CACTCTGGAGGGTA | CTTGGAGGGGGGTA | GCGGATAAGTGCTG |
| CAAAATTAGATCGC | AACTGAGGCTTGGG | AGGCCTAGTTAAGA | GCCTGGATGGCCGT |
| GGTATGGGGATGAG | AATAATGGAACATG | GCTGCCTGGTCAGA | TAACAAAGTATCAA |
| GATACGAGATATAC | TAGAGGTAGAGATG | TCCGATAAATAGGG | ATACTTAGCCCGGG |
| CAGCACAGTACTTG | ACCTCGACTGAAAT | CGTGCAATCACTGG | AGTATGAAGCGCTC |
| ATCCCCTGAATCCC | ATTAGGATCGACCC | ACATTGCCCAGTCG | CACTCAGGATACAT |
| CATTGAGGACTGCC | CACTTGCACGGGCT | ACCGTACCTGAGAT | CGGTCATAACTCAG |
| GCGGTGCTACCTGG | ATTGAGAGGTACCA | GCGCGTGTTAAGGC | TACAGTAACGGGTA |
| CATAGTCCTCAAAG | GATAGATAGACAGT | ACAGGTCTCTCAGC | TAGGGTCGATAGC |
| CCTGCATGCGCGTG | GAAGCATGGGCATT | GAAGTAGAGTCCTG | TCCAGAGCGGTATC |
| CCGGTGCAACCATT | GCAAATCACTCCTG | GTGACCTCCGAAAT | GAACAAACATATTC |
| CGGAAGTTGATCAG | TGCGTCCAGGCTGC | ACGGTCCTGATGCA | GCCCTAGCGTGCCT |
| GAATCTACTAACCC | AGGTCGACGCCATT | TGGACGCTTGAAAA | CTTACCACATGAGA |
| GACTCCACTATAC | TGGAGGCAAGTGTC | CGTGTCGCAGGTCA | AACCGCTTAGTCAG |
| GGTCTCAAATCGAC | AACCCGATTAGTG | ACGGTCAGGCTGAT | AACGTCCGTGCATC |
| TTGGGACTAGGGCA | TTGCCATGCGACAC | TCCGACGTACTCAG | TTGAAACACCGTAA |
| TCCTGCGCTACCAC | ATATAAAGCACTAA | CTCGCAAAATATAC | TGAGATAATAGGAA |
| TCACGTCCGCCATA | GGCATAATAGAACT | AAGCTTAACACCA | CTTAGACAAAGGTC |
| GCCCAGACGTTGGT | GTTAGCGGCTCCGC | GCGGCTAGCGTCTC | CCCGTCAGATTAGG |
| TCACGTTCCCAACC | CTACCCCTAAGGTG | TGGATCCCTCAGGA | CGAGGGTACGTAAT |
| CAGTGGAAGCGTCT | GTATGACAAGTAGA | CTCAGGCTCTACAC | CACGTCTGGCGGAT |
| AACACTGTGGGGTG | TACCTGGCGCTCCC | TCCTGGGACCAAAT | CGTGGTGAGTGAAG |
| ACTATGTGGGGACC | TCGCCCAGCGGATT | AGGTAGCCCTCTGC | ATTGAGAATGGAAC |
| TATGTCAACCGGCG | AGCGCAGATTGTGG | GGACGTTTACAGAC | TTACGAAGTCACAG |
| GCCTGTACAAAACT | CATGCATCTGACAA | ACTTGCGCTGGGAC | TCTGACGTACCGCC |
| CTTCCAGATGCAAC | TGCTAACCTACCCG | ACGATTGAGCCAAT | AGGGACTTGATCCC |
| CCCAAGATTAAACT | CTACTGTAGAGGGA | AGATTGCACCGCGT | AGTAGTCCGGTAGC |
| CTTAGTAACAAGCG | AGTGAGAACAGGTT | GACCGCTCGTTGGC | GCTTGCCCGAAATA |
| CACTTCAACCCTCC | TAAGAGAACTCTCA | TCACAAGTATACGC | TAGATTCAGCACCG |
| AATTACCGTGGCAA | TGCTCGAAGGATAG | CCGGCTAAGTCGGT | CTGTCATGCGGCGG |
| AGCTACATAAATGG | AAGAAAAGAACTTT | GGATAATGAGGCTC | AGACTAGTGATAAA |
| TCAGGCGATGACTA | TTCGCCCTAGCCCA | ACTGAGCCCAGTGT | CAGTCTAAATCGCG |
| AGTATGTCCCGCAG | CGGATCATCACAGT | CAGATTAACAAGGT | TGAGGTTGGACGAG |
| AGAACTCTGGGAGT | AAGCCGATTGGATA | ATGGACGACCGTTC | TCATTCACGGGGAC |
| ATCCTGACCGTGGG | AGATTCAACGTAAC | GGGGACTCCTCTCA | CAGGTAAGCCATTG |
| CTGACATGCATGAG | ACAAGAGCTTAGGT | CCAAAAGTGATTGA | CGGTGCTAGTGAGC |
| CAGAAAAGTTCCCT | TCCGGCATTCCGGA | GGCGAGTTCGCCTC | ATGCACACGATATA |
| CAGTATCGATCGGA | GTCCTCAGCCTCCC | ATCGTACAATGCAA | GATTGCGTACCGAG |

FIG. 7 (Cont.)

| | | | |
|---|---|---|---|
| CTCCGACAACTGCT | ATCGTCCGACATCC | AGAAGTATTAGCTC | TCATCTGAACCGGT |
| CCACGAGATTGAGT | ACGCCTATATGCGA | CGCCGATTATTAAA | CGCTACTGCTGTAA |
| TCGTCGCCGACCTG | ATCGCACGCTGCTC | TGCAGTATCGCCGT | TAAGTGACAGTTGG |
| TCGGGCTCGTGGGC | TCATTGGGAATGGC | CTAATATCAATGCA | CAGAGGTGAATTTA |
| AGGACGGGTAATTG | CCTTACGCATCGTC | GGGGATGATGGTCT | GCCCCTCATTCGTA |
| AGTATGAAGTAGGA | ACGGGTTGAGATGT | TGTGCGCGAATCTG | CCCTGCTGATACTG |
| TCTTAAGAGACACC | AGAATGAGGGCTTT | CCGCTTGTTGCAAC | AGTTGTCGGTGGAA |
| GCGCGACTTGAGCT | GCTCAATCTTGGGC | CATTGGGGGTATCA | GGAGAGTTGTGTGG |
| ATTGCTCCGGAGCA | GTATGCCTAGCATG | CATAAATCAAGATT | TGCCAGCCCTGTCT |
| GTCGTGCGGAGGGT | TCAAGTCTTGCCAA | GGCCGTAGTCTCTG | GATCATTAGACTGA |
| ATGGCTACCGTCGG | AATATACCGTCAGT | TATATGGACTAAAC | GTTGATACAACGTC |
| AGGATCGGTGGATG | TCAACGTCTCTCCC | TAAACTCCTCCAGT | AGACGCGGTCTTTA |
| CAAACTCGGTCGTG | ATCGTTGATCCGGG | CTCGGGTAATGTCC | AGCTTTAGAATACC |
| GGCGCTAGCATCCT | GTGTATGACAGGCT | GTATGTAGGACCGT | TTCTGCCCATAGCA |
| AGAGAAGAAATATT | TTTGCAACGTGCAC | CTCCATACGTTAAA | ACCTGCCTCCGATT |
| CGTTGGGACGTAGA | ACCTCTGGCACTTA | ATTGCAGCCCACTT | CTCGTCGCGAAGTT |
| GGAACGTCCCCTTA | GCTAAGGATGAATT | CACATCTCCGACTT | AGAAGCTTACTTAA |
| CGGTGCTGGAGGTA | GCGTCTCTCAATAG | ACTCAGCGGTATGT | TTGCTCGCCAAAGT |
| GGGTAACAGGACTT | GCCAATATGTCACT | ATAGATCGTGAGTA | GTTCTTACCCGCAA |
| ACCTCTCTGCACGG | TGTAGGGACTCCT | TTCAGCCATCGCTG | TCTTCATACCAGCC |
| CACGGTAACTCGTG | ACTCAATCTAGACT | GTCTATGCCGTAGC | GAGCGAATTCTAGT |
| GTCTAGCATGGAGG | AGGTAATCTCACTC | GCCGTAGTTGTGCC | AAGGCGAATTTGTC |
| ATCGTCCGAGCGGT | GTGCGTTAGGATCG | ACTGCGCGTCTAGT | GAAGTCCGTTAATA |
| GTGCGAATACTGCC | ATCAGAGCCGTTAT | TCTGAGTTAAAGGG | ATTTGACCATGAAA |
| CATCCTAGGCTCGA | ATCGCTCCGCCGTT | CCACGCTTGGATAT | TATACAGTAGTGCA |
| CTGAACGAATCTCG | TACGGGGATACGTT | TGTCAATCAGCATG | AATCATCACTGCTC |
| TATGTAAGAACCAA | GATCAACTATTCGC | ACTATTGGTAAACG | GAGACGGGATTTTG |
| CTGAAAAGATCTAC | TCAAGTGTATGAAA | TCGCAATGATTGAA | GATAGCTTCGGATA |
| AGATTACCCCGTAA | CTCCCGAGTCCTGT | TCTTCCGGACTAAG | TACGGACGTTGTAA |
| GATCGCGATATAGC | ATGCTGGTGCCAGT | TCCTGGTTCCACCA | TCCAGTCCAGGGTT |
| GCCACCGAGATTGT | ATAGTGCAAGATTG | CTGATTAGGTAGAA | AATAAGACTGGTTG |
| GGTATCAGATGACA | ATAGGCGTCTAGGT | GTGTCATGGCTAAG | AGTGACTCGCATTC |
| CGGTGGCATCCTGA | TAAAATACCTCTGG | ACGACCTCTAAGTT | CTCCCGCTTCGCCT |
| TACTAACGAGTGAA | GCTCCATCATCTG | CCTAGTAGATGTCA | TTGGCTGAGCAAAT |
| TCCGCTCCCAGTGG | GCAACTGAATATGT | AAGTAGTTGAAATC | TCCCCACCTTGATA |
| AGATAGAGTTGAGA | GCGCTTTGCGAATA | ACTTCTGACAATGG | AAGGAGTGTTCTCG |
| TAATGCACGGTGCG | CTTAGCGGAGTACT | CCGAATTAATAGGT | ACGGTGGCGTTTAA |
| TCGTTCAAACAACC | TAGCCGGTACTAGT | TACCGAATCAATTG | CTTCACATCGGATG |
| TAGGAACTAGGATC | CGTTAAGTTCCGCG | GTCGACGTGGCGTT | CTTTTCGCGGGCAC |
| CTCGTTCGACAGAA | CTATCTGGCTCAGA | TGTAATGCGAGTAG | TTCGGGGTATCCGG |
| CGGGACTGGATGAT | AGGATTGGAATTGG | ATTAGTTCGCCAGG | CTGCCTGGGTTCAA |
| ACTGTGCCATGCCG | GATCTACGTAATGC | GTCACCTGTCGATA | TTGCCTAAAGCTCA |
| GTTTACGCGAAAAG | TCGTCCGAGGTGTA | TTTGAAAGCCATAG | ACCTAGCATTAGAT |

FIG. 7 (Cont.)

| | | | |
|---|---|---|---|
| GCTTCCCACTTGCA | CGTTGTCTAGAACG | AACCGTGTCCTGTG | CCTTGGAAATTGAC |
| GAACAAGTCTTTCG | GCTGATCGCGTTAA | GGTGCTTCTGAGCG | GACTCCTGTGCGTC |
| ATGCATCAATATGG | TCGGGATTGCGGTA | ACTGTCTGTCCCAC | TAATCAAACCCATT |
| AGCATTATGTACGC | TGGGCGAACGGTTT | ACTAGTACTCATGA | AAATGGTCCTATAA |
| AATAGATCACGTTC | TAACCTTCAGTGAA | ACTCTGGTCTCGAG | ATTCTGGGCCTCAC |
| CGGATAATCTTCCG | GACATACCTTGAAT | CTACAGCATGCTGT | AATTTCCGAAAACT |
| AACATTACGGGTGT | AAGAAATTTCACGT | GTGTCTCAGGGATG | ACGCTATAGGAGTT |
| TCACATATGCATCA | ACCCTAGGTACTAT | CGGGTGTGGTGCTC | TAGGAGGAATTTAC |
| AGTCTGGCCTTGGC | TACGCATAGGTGTA | CAGTGGTCACACTT | CTGCAAGCATATCT |
| ATTAAAGTAGCGGT | ATCGGGGTTCTAAC | GCCTCCGCGTCTTG | TGGGTCACTGCCTC |
| ATCATTCCCCATAC | GAGTGCTGCGGGTT | TGTACGTCCCATGC | GGACGACTTCGTTG |
| TCTCGCCCATCTAG | CCTCCCTCCGAATT | GGAATACCATGTCT | GACACTACTCTGGT |
| ATCACGTGATCAGT | TGCCCTGCGTTGAA | GCCTGATATCATCC | CCATGTCGACTTAC |
| GATAAACACATTAT | AGCGTGCCATCTAT | GGATTCGTGCCGGT | CCAGGCCTTTGACT |
| ATCAAACTGCATTA | TAGCTCAGGTGAGT | TCTAGGCGGTGATA | ATGCGCTCGCGTGT |
| GAGGTATCCTCCAT | GACCCTTTCGCGTA | AATCTCAACCGTAT | GATAACTAGTAGTC |
| AGAATTTGCGAGCT | TTTAAGGTCGAGAC | ATAACACTTCCGTG | GGATATCTGGGTGC |
| GCTAAGTTCCGTCC | CTCGGGCTTACGTC | TCTGTACCGCGTCC | GCTCCGCTATAGAT |
| AGCGGTTCAATCTG | AGTGGGATGTGTAC | ATTGCATATACGAC | CCTCTCCATAACGT |
| GATTGGGATGCTAC | GCTATGTCAGCGGT | GTGGGGAAGTATTA | ACCCGTCAAGTCTT |
| GAGTACTATGTCCA | ACCGGTAATTCCCT | TATGAGGCCTGTGG | ACTGGTCCGTGAGT |
| GTTACCAACCTTCA | CGTCCACTTGGGAT | GGTAGCTTCCTGGG | GTGCATGGGTAACT |
| TCCACCTTTCAGAG | CATCAGTACCTCTA | TAATCGATATAGCC | TCTTGAACTAACGG |
| TGAAACTATCTAAA | TTAGACGATATGGA | AAGCTCGCCTCTTC | CTGCGCTCTTAAAC |
| GGAATATACTATAC | CTGCGCTATATGGC | TATAGTATAACGCA | TCTCCCAAGATGTC |
| TATGGGTAATGAGA | GTGGTTGGAAACAT | TCGTCAGCGGATGT | ATTACTAACCACAT |
| CTTGCTGGACAGGT | TACCTGCGCTACTA | CACTCTTGCCGATC | TTTACAAGCGATGA |
| TTCATCGTCAGGAC | TTATACCAGCCCTC | TTTCAGCTCCGACA | TAGTGTTGCCCGCA |
| GTGTGAATGTCCAA | CTGCTCCTGGAATG | CATACCAACTTAAT | TGAATGGAGCGTCT |
| GTAAACCTAGTTGA | TCACTGTGCGTCAA | TCGTAATGGCCTCC | ATGATGTTACCCCA |
| GTGTCGTACGAGTG | TGTGAACAAAACTT | GCTGCGTAGAATAT | TAGAATTTAAGGAA |
| GCTTAAGTCCGCTC | GGTGTGCCGTCGTC | TATTGCCAACTAGG | TACGCCATAGTCTG |
| GTCTTGGCGTCGGC | CCTTCCAATATAAC | GTCCCTCGCGATCT | GCGTTACCCATATA |
| AAATGCGCTCTTAG | TGTTGATGCAGCAC | GCATTGTCCACTGC | TAGTCCGCCATCGT |
| CGGTCGACTGGTTA | TCTTAGAATCAGAC | CTTGCACGGTCCTG | GTACACACTTTCGG |
| TAGGGCTAAATTGG | GACACTTAATCCGT | GGCTGTGTCCCCCT | TGGGCTTTGGAGGG |
| TTGACGGGCTGGGT | TATGTAGGTAGCGC | GAGTGATTCGTCGG | TATGGCGTTCAAAG |
| CTAAAGCACTTTCC | TACTCCGCCAATTG | TTCCCGTCTACAGG | ACGTCGCTGACTCT |
| ACAAGTTCAAAATT | GCGGGTTCTGTCGG | CATATTCAGCGCTA | CTACGTCCTATGAA |
| TCATAGATTGCCCC | ATTACACCATGCGT | GTGTTCACCGCTGG | GTTTCTAGGCAAAC |
| CGTCCGGCATGTCT | TTGGCAGACGTTCC | TAGACGGTGTACGT | TTACATTGCCGAAC |
| TTCTAAAAGCATCG | ACTGCGTCCTCCTC | CTTGGCAAGTTGAA | GATCTTACACCACT |
| CGTGCAGATTGGTC | ATCCTCGAATCTAC | GCTGAGATAGTTGG | GGATAACTCCTACT |

FIG. 7 (Cont.)

| | | | |
|---|---|---|---|
| AATTCGTTACCAAA | ACAATTGTGGCGTC | TGCCATTCGACAGT | AAATATTGGACGTC |
| TAAACGGTGGCATT | GGTCTAGTACCATC | AATGTGTGAACTGG | CACGAGATTAGTTA |
| AACAGTGAATAATT | AGAATTTAGTCAAC | CTCTGACCCCGGTT | GTCTGGCGATACTC |
| CTATACGTTACGGC | AAGGTAGATGTCCT | ATATACGAATGATG | AAGCCAGCTGTTTC |
| TCACGGTCTGCAGT | TACTCGCTCTAGAG | CTCTCCTTGCAAAG | CTCCAAACTTGTGC |
| ATCGCCTCACATTA | TATTCACGGCTCCC | GGGTAGTTCGGATA | CAACGCCTCTTCGT |
| TAAAAATGATGGGT | TCGGGTCGAATGGT | TAGTTTCGCGGGAG | TCGGATCTAGGCAT |
| GATGTAACTACGAT | GAGTGAGTGTACCT | CGACTTTACTGAGC | GATGGAGTAGTGGT |
| TAGAGATTGTAAAG | AGTGTAGCTAATCG | TCTGACGAAGCTTA | TCCGTATGGCTCGA |
| TGCGACTGTATCAC | GTGACCTTAATAAG | CATCGGCCTTTGGG | TACTTGCTAAAAGA |
| GACCCACTTATAAT | TATTGCACGGAAAT | AACTCCCCCTCTCT | GACCGGGTTTGTGC |
| TCGAAGCATAGATT | GGTTTGCCAATCCG | GTCAAAATTATCGG | AGCACTTTGCGTAG |
| GTAAAGGTTCCGGT | CAGTCGTTCCGCCT | TTGGGGATTAGGAA | AACTTAATCAGTAG |
| GGCGTCATTCGCCT | GACTGGACTGTGTC | TACTGGTCAGTCCA | CTGTTAACTCCACG |
| TCAATAGCCTAGTC | ACCATTTGACCAA | CGTTGTCATAAGAA | TTAAGGATATCACA |
| CATTTATCCAACGC | CAGTGCAAGTTCTA | TTTCGGGGTAACCA | ATTGTGCGCCCCGT |
| CCCATTCGGATCGT | GCCAAATTGATAA | ATGTACCATGTAAC | CAGGCATGTTTGCG |
| GCATCTTAACGTAC | TGACGGGTTGGTGG | TGAAGACACATTTC | CAATTCACTAAGAT |
| GGCTTTCCCCCGTA | AACTCCATTATCGC | GAGTGAAATAATTG | ATTTGCGAACGACT |
| CCGTGGTCTATGGG | GGTTGGTAAGTGCC | GCGTGTATGATAAA | AACTTCATGGATAA |
| AATTTACTCGCGGA | ACCAATGAGTCGTT | GAACTAAATACTTC | TTAAGGCACGATCT |
| TACCTCGGTGGCCT | AGTCTTTAGCGACC | CCGCTTCTCATGAG | GTAGTTACATGAGA |
| TCCCCCACACTTTA | CTTGTAGAATCGAA | TTACCCTTACGAGA | GCTTCCTCTACGAA |
| CCCTTGCGTGTACC | TAACACGTCATAGT | CCTTACTTGACAAC | TAAGACGGCCTTAT |
| ATTAACGTCTCACA | CGTAGAGTGAGTTA | TACTTCGACGCATG | TGAGAGGGTTCTGC |
| GCCTTTCGTACGAC | ACGGTGTCCGGTCT | AACAATTTCTCACG | CTTAACGAATAGTA |
| GCATATTGTACCGA | GTCGTGGCTAGATA | GCTTGACCTCGGGT | CATGGTTGTCGAAC |
| TGATTTAGCACGGA | TCATCTACTGCGAG | ACGTGTTGGACGGT | TATCGGAGAAAGTT |
| AGGTTAGTACACTA | GTGAGATTCTGACA | AAAGCCAACTTCTT | TACTTACAGCTGAG |
| TGCGCTCCCTGCTA | ACTGGCGCTTCTCA | TTCAGTCAGTACGC | CGCTTTACCCTACG |
| TACAAGTTCAAAGT | TTCCCCTATAGGAG | CAGCTCATCTACAT | CACTGAGGTATATC |
| ATGGCTGGCCCTTG | CCTATCCACACTTA | ATTTGACACCAGTA | AAATGCTATTGAAC |
| CGCCTAAGATGTTA | TATTCGAGCAGGCT | ACTTTCGGGGTACA | ATAGCCGTTTGACG |
| GTGCCCACTCCCTT | CCTCAACTCCCTGT | GACTTTCTCCGACC | CTTTCGGAATACGG |
| GAAGTGTTAGCGTA | AATCCGTGAATGTG | AGAATTCATAGGCT | AGGCTTATGGAAAT |
| TAGCGTCCTTGAGC | GAGGCTGTTCGTGC | AAGTTTCGGAACAT | TTGAGGCCGTAAAT |
| ACGCTCTCGGTTGA | TGCGATATTAGCCC | GTTAAACCATCGTG | GGTGAAGGATTCCT |
| GCGTTCTTGGGAGG | AGCTAACATTTACG | CCTACGACTTATAA | GAGATCTGGTTCAG |
| ATCTGTCAAAGAGT | TATAATTACGAGCC | AGTGTTTGCGACGC | TTGGTTACGAACAA |
| CTATCCAGAAATGT | GCTGGATTGTCAAC | GAGCTATGTATCCG | TGTAAGGAGATGCT |
| CAATGACCAGTTTG | CTAGGCCCTTCGTG | GTCAACATTAATAC | CGTCGTTAACCCAT |
| AGCATGTCGGAATT | GCCGTCCATAGTGT | GAGCTTTGGAAGTC | TTGGTAAAACTGGA |
| AAGTGGATAGCTTC | CTCACAGGTTCTGG | GTGTCGATCAGCAT | CTGTCAACTTGGGA |

FIG. 7 (Cont.)

| | | | |
|---|---|---|---|
| TTCAGCTTGAGAGG | CTGCGTTAGCCGG | GCTATTGGGCATAG | TGAATCCTCCATCC |
| GAATTCTGAGATGG | TAGCCTGATCGCGT | CATTTCCGGTGAAA | CGGTGTGCCGTGTC |
| AGTAGGTCAACTAT | ATGGTATAAGGGGT | GGTCTGTGTAGGGC | GGAACGGGTATTGT |
| CGCTTGCTGAGCAT | CTTTTGAACGACAA | ATTGACAGTAGCGT | TTCGCCCTCTACGG |
| ACCTTATTGCAGAA | TAGTCTAAACAAGT | AACAGCTGTTTACC | ACTAGGTGGCTTCA |
| GTGGGCAATAGTAT | AGTCTATTCGGCCG | CTCTGCGAGGATTC | TCTCAGGGCTTCGG |
| TACTACTACATCCC | GAACTAGAGTATGT | AAATTGAGAGTCAT | CTGGTGCCGGTGTG |
| TGGTTCGAGCACAT | GTATAGATCGACTA | AGGATATCTACGTC | ACAAATAGTGATTC |
| GGTCTTCAATGACG | ACACTTCGTTCGCA | AACGTGATATTAAG | ATCATCGTCCATGA |
| ATTCAGACATCGCT | TTGGCCAACCCTCT | AATTACAGATCCTC | AAACAGATTTTCCC |
| GGGGCTCAACCTTT | CATCAGTGGCCTAT | TGCTGTTAGGCAAG | TCCAGGGGTTCTAC |
| AACGACTTTAAACT | TAGCTGTCAGCGCT | AAAAGTCCTTTCAA | CTAAAAGTCAGTTG |
| ATGATAGTCTAAGC | TCAAAAAGTTCTAA | TAGTACGCTAGGCT | TTCTCGAGCCAGGT |
| GTACCACCGCTTTA | ATGATCTCCCTCCG | TAGGACCTGTCTCA | TGGTGTGGTGGGGC |
| GGAACTTTCGGTAA | AGCGACGTTTGCAT | ATGGTTCGGGTAGG | GGCTATTAATGGGC |
| GGCAAGTGTATCTG | CCGTTTAAGCGCGT | CATAAAGGGGTTTA | AGTGCTAGACTTCA |
| GTTCGCATGATACG | GGTGTCACACGGTT | GGCGTGACTATTGC | CCAGGTTGATCATC |
| AGGACCCTCTATTG | ATGTGGTCGTAGAC | GACGTTCACTCGAT | TTCATCCGGAAATA |
| AGTTATCCGTACCG | CTCCGTATTGAGCG | GACATTTGAGATAA | CCTCTATGCTGCGC |
| GCACTCGCGGTATT | TAACTCTCTGCCAA | GACGACCCTTTGTC | TAACATCTGCGGTG |
| CTGCCCGATGTTAG | ACCTGTTAGCACTA | TGGGCTGTTACAAG | TTACTGTAGGCGCC |
| ATACTGATCCGCCT | CAGTCCCTTTGCAG | ATTCAATGATCCGG | ATATCGAGTTCACC |
| AGATTTGTAGGAAC | TGACTATTGCGGAC | AAGAAGCTTATTGG | TCTCTTAAACGCAC |
| GAGTCGCTGTATGC | CCGTTCGTTAACAG | CGGAACTGTTCGGT | GGCTTTTGGAGAGC |
| CGGTTATCGAGATC | TACTAAGTTACCGA | TCGGTCAACATTCC | GTAAGAATGCATCT |
| TCGAGCGGCTGTAT | CAGGATTTGCGCGT | TTGACCCTCACTGA | TGATGTACAAAATC |
| ACGCTGTTAAACAT | GCATTTGCCATGGA | TCCCGATCAGTTAG | CGGGAAGTATTGAT |
| CCGTTTACGATGCG | TGAGCATGTACATC | CTTCTCAAGACTCG | TTCTCGGGGGGCTG |
| CTTGTGACCTCCGC | TTGCGTATGGGCCA | ATTATCCCAACTCC | TCAGGATTAGATCA |
| AAAGTATTGACATC | TACTGAAGTCTGAC | TAGCTACACTGCCT | TCAGTGCTGCGCTG |
| GTGATGAGGTGCGT | CGTCCTGCTCACCT | CTGGGGTTGAATAG | CGGGACTAGTTATA |
| TATAGCGTACGGCT | TGTCTGGTGACAGG | CTCTGTCCGATACA | ATGTCCCCCTTAAA |
| CCTCTAATATCGCC | TATGGATTCAAAAC | CATGGTGGTTCGCG | TGCCGATGTGACGT |
| GTTTGGTCCGACCA | CTGCACAATCGTTA | GCAACAGTAATTTG | TGCTAAATGGCGCT |
| CTTAGCAATCAGGT | CGCAACCTTATCGT | GTGCAGCTTGTCGC | ATCCCTAAAACTTG |
| TATCAGGCTCATAC | TCGGCTATAATCGC | TCCTACTTAGCAAA | CCAGATACGTTATC |
| CTGAACCTAGGCTT | CTGGAAAGACGTTT | ATAAAAGTGTCGT | CGGCTATAAAATGT |
| ACGTTGAGTGCTGA | ATGTATCCATCCCC | GATACTCGCTGATC | CTGCGAATCTAATC |
| CAGTTCAACTGGTC | CATCTGGTATAACC | CACTCTTAGACGGT | ATACACATTCTACA |
| GTCTATACTCCCGC | CCATATCATCGACT | TGCCCTGGAGGTCT | TCCTAGGCTTAAAG |
| CCGATTGGCCTGTG | AGTCTCAGCTCGCT | AGTGAATATGATAC | GTATACAAGTGTAG |
| ATTCGGTACCCCCT | TCTACTCGAGGAGT | CCTTGGGCCTCGCT | AGAGTCATACTAGT |
| TCATATCATGAGGC | CTCCATGAACAATT | TACGATGCGCGATT | TCCCTCCATTGGGG |

FIG. 7 (Cont.)

| | | | |
|---|---|---|---|
| CATGTGTTCGCCCG | CCAATCGGCTCTGT | CCCATCGTCGCTTG | TTGACATTACCGAG |
| CGATTATCCCGGCT | GCTGTCCTATCAGC | AGTTGGGTCGGACT | TAAGGGTATGTCGA |
| GCCATATATAACTG | CGATGTCCTACTGC | CATTGCTCAACTGA | ATGTGCTTGCACGC |
| AATTGATAGTAGGA | CGAGATGGGTTACT | CAAGAGATGTATTC | GCTCTAGAACTTAG |
| AGTTCAGTGGATGG | TGTTAGCCGCATAG | GAGAATAGCATTTG | TACTACCCTGGTGG |
| CAATGGGTGAGTGT | AGAATCCTGTGATG | CGCCACTTGTAGGT | TAAATTCACGAAGT |
| GATCTAATGCGTAC | TTATCGTAGACCGA | CTACCTATAACGAT | CCCTGCTGGCTTGG |
| TAGCAGGCGTCTGT | GGAGCACGGATTTT | AATTTGGTCGGCAG | GGGTTCGCCTTGCG |
| TAGACTTCTAAGGG | CGATAGAGTGTAAT | CGCAGGTCTGGGTT | TGTCTGGCTGGAGC |
| TTCGGCTCCTGAAG | CAGCCCTTGAAGTT | AAGTAAGTACTTGG | ACATTCTCTGGCGC |
| GGAGCGTGACTATT | ATGGCGACATCTTC | CGTAAAATATCCTC | GAAGTTACTCACAT |
| AGGTATCGGATCTC | CTACTCGCCGTTAC | TTAGTAGCCTCACG | GCGATTTGATCCCG |
| AAACCTACTAATTA | AGAAAATCTTTCGG | CACTGGGGTGTGCT | CCATAGGTCCATTC |
| GCAAGCTGATTTGC | GACAATGGGGTGTT | TTGTGTCGGGGAAC | ATCGCAGCTTCATA |
| ATAACGTGCGTTCC | GCCTTAGCCTGTAG | TACGTATTCGGGCG | GTAGCTCTCCTGAA |
| TCTAATCACCGATA | AACGGAATTTGGTA | CGGAGCTTTACTAG | CATGATGGCCCTGT |
| GTTAAGACCTGATG | TGAACTAGAACTGT | ACGGAGCTTATGAT | AGTCGTTTCACCAA |
| AGTGTCCAATAGTG | ACATGTGGAATCCT | CTGTCTGTGCGAAA | TCCAATCGGTAGGT |
| ATAAGTGAAACTAT | TACAGGCCATCATT | GTGTGGTATAGCCA | AGTCGGTGTCATCC |
| ATAGCCCCTGTCGT | TTCTCTACACGAAA | GATCGTCTCAGGTC | AGGCTTTCAGCATA |
| TGCTGAGCGTGTAC | ACAAAGATTTGAAT | GACGGGCTCCCTTT | TTTATAAGACGCAG |
| TACGCTCGACCTGT | ACCGTTAATAAATA | AACTAATGTTGCAG | CTGGCCTCTATGCA |
| GATCAGTGTGTCAA | ACTGATACTTAGCC | TTACCTGGCCCTCA | GCGTTTGCGGGTCG |
| TCATAATCCAGTGG | TACCCTAGATTCGC | GTGTCAGTGCGGTG | GGATTTTCGGAGGC |
| AGATAAACCATTTC | CCACGATCCTGTTG | TGCGGTCAACTATA | TGCTGGTATGGACA |
| TCGTCTACCCCTGG | TGCCGTTCGCTCGC | TGACGCTTCACTGA | GTTTGGACAATAAC |
| GGACGATGGTGGTT | ATTGATATCCGGGG | TAGACGTAGATTAA | GCGGCATGCATTGT |
| GCCCTGTGACCTGT | GAGTCGCGTCGTCT | TGGAGCACATGTTA | TTCAGTGCCATGGA |
| AAGCGTAAATTGGT | TAGACAGTTCGCTG | TGTACGCCCACATT | GCAGAGTAATTTCA |
| AATAGGTGGTAGAT | AATCTTAGAGGGTA | GCCCCTGATCGTTG | TCTACAAACGTCAT |
| GTTTACGATGGACA | CCTTGAAGAACTGT | TTGGGTTACAGCAG | CTGCCGACGAATTT |
| AACATATAATGGTG | GTCGTGTGTGAGCG | GTGTCGCTACAGCT | CTTGCACGGCTAAT |
| AGTAATGGCTAGTC | CCCTGGACGTATGT | TGCCAATTCAGTAA | ACGTGTCCCATGCT |
| GTTGAGCAAGTTCC | CTACCCGCTCGATT | GCGACTTCGTATAC | TCATCCAACAGGTT |
| ACAACTACTGCTCT | CGTCTGCACTATGG | CAAGCCACGTGTTT | ACTGTGACCCTCTG |
| GTGATAGAGTTGGA | AGTGTATTACAGGG | CAGTCTCGATTACC | ACGGCTTTCGCCTA |
| CTCTATCAGGGTCA | ATGTTAGGAAGAAT | GAATAGACATCTAT | TGATTATCGACAGG |
| CACATCATGTGCTG | TAACCTTCAACCCT | AGGCGTATTAGTCG | CCCAATATTTACAG |
| AGAGTCGTTGCTCG | GTTACGCCTTAGGG | TTGACGGTCGTCCA | GTCATGTACATAAG |
| CCCGAGTCTGTCTC | TACATTTGGCGCCC | CATAATGTAACTAA | CCACCGACTCTTTG |
| CATAGAGATGTTGC | ACTCGACTGCTCTA | AAAGTCGTTCGTAA | CACCTCGTCTTGGC |
| GAGAGTCATACCTT | ATATGCTTAAACCA | GAAGTTGTCTGCAC | AGTAGATTGCAGTC |
| CGGTCTTCGGGCCT | TTAGCTGTGAGCAA | TTAAACATACCCTA | GTACGCTCCGTCTA |

FIG. 7 (Cont.)

| | | | |
|---|---|---|---|
| CCGTTCCTGGCGCT | TGGACATATTAACA | TTATCAGCGAGAGT | CGCGCTGTTCGCTA |
| ACGTTTCGACCGAT | CTACCGCCATTCTC | AACAAATTCGCTGT | CCCCAGGATTGTCT |
| GTGCTTGATCACAA | ATCTTGACTCGCCG | CGCCAACTCATTTC | TCTGACGGTACATG |
| TCACCAAAGTACTT | TAGGCTGATTCAGC | GCATATCTGCACCT | GCCTGAACTTTCGC |
| CGTTAATATAGCGG | TTTGGTGCCAAACA | AGTCGGTCATGCGT | CGCGTCTATAGGTG |
| TATGCAGCTAAATC | CACGATCTTTCCAC | CGGTGACGTTAAAT | AAGAATGGCTTGCT |
| GTGCTTGCTCGACG | ACTATGGTTCGCGG | GATAATTCGCGCAT | GTGAGCAGGCCTTT |
| CCCCGTTGTTGACG | GTCTCCTGATGGAA | ACTAATCTAACCCT | CTACTTAGTGCGCC |
| CCTGCGAAAATCTT | CAATTGTGCAGGTA | GTCCGTTCGTAGCA | ACGTGTGACTTAAA |
| TGTCACACGGGTAT | TACGGCGTGATTGC | GGAATTCCGATGTG | TAACTACATTCCGC |
| AAATCTGCTGTGCC | GAGATTCGTCTGGG | TTGAACCACCTCGT | CTGAGCCCTGTGAT |
| AGGTCTCTTCGAAG | CGGTTAATGCCTAA | TATAACCGTAGTGA | CATCGGATGCTCAT |
| CGACCGTTCCTAGT | GAACGCTATCGTTC | CTTGTACTAGGAGC | CGTGTCCCTGGGTC |
| TCCGCGTCTCCTCA | CTCCTTCTGCGAGG | TCTGCGCGTTAGCG | AATATGGGTAGATC |
| AGTAGTAGTTACGG | CTGTGCATGAATCC | CTCGAGTGCATATG | GCGGTGATGCTCGT |
| GTGATGCAGGCTAT | CAATCTTCTAGGAG | CTATTGCATCGAAA | GGCCTGCTATATCC |
| TCAGCTACAAGTTC | GCTGGCACTACATT | GGTGGTTAGTAAGA | TTCGCACAGAGTTA |
| TCCCTCACCTACTC | TTAGCGCTCGCCTC | ACTACAGTGTTACA | TTGACACCTGAGTG |
| ACTCTTAGTGGCAG | TGGGGGTGTCCTAG | GCATCACAATTACT | CACGCTAGTATGTA |
| GAAGTGATCTTACC | GGCCTTACGGTGTC | GGGTGTGACAGTTG | AAGTCTCGTCGGTA |
| ACGGTTATATAGCA | GTGTGGAGTCCGGT | TTAGCCGTGCCGTA | GGGTATCCCCTCT |
| GGGTGATTAACTAA | TGTAATGCGTCGCA | ACATGGAACATCTT | TAGTTCAAAAGATG |
| TTAAGATGTAGGAG | CTGAGTGACATGAT | CTGGGACTATGCTC | CAACAAATTTTGGA |
| ACTAAGCTCTCATC | CCTTAATCCGATAA | TGTCACGGTACCGT | GTGGTGAGATATGC |
| CTGGCTTGAATAAA | ATCTTAAACCCGTG | ATACTCTCGGTCCC | GAAACTGTCATGTC |
| AAACCGCTTGTGAT | TCACTCGGTGAGTC | TATCAACTAAGACT | GTCCGGGATCGTAT |
| GTAACGTCTAGGTG | TCACAACAGCTTTC | ATTGGGGGATGAGT | GGTGAAGTGATGTG |
| ACTGTCGAGCCTCT | ATCCTCTGAAAATG | CTCAATGCTAGTGG | CACTTCGAGACCTT |
| ATTTGGGTGAAGCA | CGCGGTCCTTCGAT | TTGGCTCCGAGTAC | TTATGGGCGTGCCA |
| TCGTCTCGCAAATA | CATTACCTTGGACG | ATGGAATAGAGTAT | CTGAACGTGCCTTC |
| AGCTATTATACCGC | CCCGTGCTTACTGA | CACTGAATGGTCTG | CATAGTGGCGAATT |
| CTGGGTAGATAGCT | CGCCACATTAGTCT | TGGAACGCTCATAT | CCAATGCTGGTAGT |
| CCTCCACTTATGCG | CCTGCAGGCTTCTC | ATTCACGAGAGTCT | CGTTTAAGAGGCAT |
| ACTCCTAGGGTATG | CATGTGCTACATAA | ATGGGATGCTGCGT | GCATTCTCGGCGTG |
| CCTTTACTGACGGC | AACTAACTGTATCG | ACATGAAGCTTATC | AAGAGCTTACTCCT |
| ACTGTCGCATAATC | CCCCACTTAATCTG | CGACTGTTCCATAA | CCCCTTTCGCTCCA |
| ATCTCAGTCTCCAG | CATGATTCGACTAC | CTGGAGATAACTCT | GCCACTCTGTGTGG |
| CGCTGGCCTGCTCT | CATTGAGAGTTCAG | TGTGCAGAATAAGT | GAGGGTATAATGCT |
| AACTTTGGGCCTGG | ATCAGCATGCTTCA | ATCGCGTTCCGTCA | CAATTGCTCGATGA |
| CTCGTAATACATGG | TGTTAAAGATCCCG | CACGGGTTGCTATA | TAACCTTCGAGATG |
| AGGACTTTGAATCA | ATGCTCCGGAGATT | CAATCTACCTTAAG | CGGCATTTACGCTC |
| ATGTTAGACGTGAA | CAGAAACTATTGTC | GCTCCATTCTGACG | GGGTTCCGTTGCCC |
| AAAGATTTGCCCC | CAATTCATCGTAGG | GGTTGCAGACTTGC | TGTAGAGGTCACTA |

FIG. 7 (Cont.)

| | | | |
|---|---|---|---|
| AAAGTACGTATAAT | CACTTTGGCATGCC | CCAAGTTTATAAGG | TGTTGAACCGGGTG |
| TCGAGTTCTAACCA | ACCCTCGTTAAGTA | GGTTCATGCTACGC | GATCTGGAGTTGAC |
| ATGTTAGGTACCCC | TCAATTAAGTGACA | CTTGATACCAATGG | CTGGCGTGTGTAGG |
| ACTCGAGCGTCCTT | CACAAATTTTCGGC | GCTTACTGCGCATG | TGCGTGCGTCGGTC |
| ATGCTACTACTGGG | AACAACGTTTCTGG | ATGATCTGTGGCCA | TGACCACAATTGTG |
| TTGGTCGATAAGAC | CCATGTGTTGAGGA | GGGCTTGTGGTGCG | ACTCCAATAGCTCT |
| CAGTTGTGCCCTGG | CAGCATTTCACAAT | CCAGTACTCATGTA | CGTATCATCAATAC |
| AGTACGATGTACTG | TAGCAGATTTACGA | GTGGAAAATGGTTG | CTTGACGCTACAGT |
| GCTTCGTGAAAGCT | GGTAAATTATCAGG | GTCAAGCATGCGTT | TGAGGCTTAAATAG |
| TGCCACGTCGGTTG | AGGCTGCTGTTCGC | TCCAAATTAACTAC | CTTGAATTGAAGCA |
| CTACTTGCGAGATC | GGTATAGCCCGATT | TCGAATTATCGCAG | GCAGCACGTTTCTA |
| TAAGATTTGGGAGG | AAGTTAGAGGTATG | TCTCGCTACGGCCT | GTTGTGCCCAAATC |
| TACCCAGGTTCGTA | AGACAAATGTCTTC | TGGTGTGCAGGTAA | AGGTCACCGGTTTG |
| TTGGGCTCCCTCAA | GTGCAATCTAGCTC | ATCTCATAATCAAA | GGTAATGACGCGTT |
| ATAACTCACGTTAG | TCGTAGCCGATTAC | TGCTAAACTAGATA | AGCTTAGGCTTCCC |
| GCGTTCAGACCTTG | TACGCATCTTACCG | ACTCAGAATGTCTG | AACGTTAGCTATAG |
| CGATTAAACTCGAT | AGTGGGTCGGTATA | TGGTCGGCGTACTC | AATGATAGTCGCTC |
| ATAATTGACGTACA | ATCGCGGTGGTATG | CGCACTTTTACCCG | GCCACGTTCGTTAC |
| CTGATTTACGGAAC | TGGGTGCTCCGGCT | TCCATTAAGGATCC | GGTCCTCGCATCTC |
| GCACTGTTCGTACG | GTATAGCTATGGAG | CGCATTGTTGCGAG | TCCTTTACACCGGC |
| CTCTCATGACAGTG | TATTGAATGGGCAC | ATAATTAGAGGATC | AGTATTCTGAGAAA |
| TGCCTGGTGCACTG | AGTGAACGTGCTCT | AAGTTATCCGCCTA | GACTCTTCGGATGG |
| TCCTTACGTGGGGA | ACCAGTGGTTTAGG | TATAATCTGCCCCC | CGCGCATGATTACT |
| AAATGCGAGTCTTA | ATCTGAATTGGAGC | TTGGCATCAAAGGT | CTGCGGCTTGCTAA |
| GGGTTCGAGTAATG | GAACTCTGCTAACT | GTTCATAACAATAC | CTAGAATTAGAGTC |
| CTACTACTATCGAG | TGATCGGAGTATCA | CCGGACGAATGTTT | AGCGTCTGTTGAGC |
| AACAAAGGATTTGT | TCCGTCGAATTCCA | CCACTACACGTTGT | TATCTTAGACAAGG |
| AGTGTACTACGCCT | AGTCTTTCCAAACG | GTGCGGAGCGGTTT | TATGCACCCAATGT |
| ATCTACCCAACTGT | GTGATCCCTAATG | CTCATAAAGCCTTC | TGAAGAGAATTGAT |
| TGGGACGAGCTTGT | AATCTGCAGTTCCA | TAGTCTATCAGGGA | TGCGGTCGAACTTG |
| GTTGGATGATACCA | CTTGACATCGTGAC | CTACACTACCATTC | GATCTTGAAGGTGG |
| AGTTGTTAACGGGA | GATAGTTCGTCCCC | TGCCACGGTCAGTT | CACTATCATATCCG |
| TCATTAGCTGCCGA | TAATCTGGAAGTGC | TTTAGAACTCGGCG | CTGCACATTTCGCG |
| GTTTGTCACCAAAG | ATCCCACGTTGGAT | TCAGAATTGCTAAG | TCTTAAGGGAACTG |
| CTGTTGGCCCACTC | ACGTAATTACTAAA | TTAAATATGCACAG | TGGGTTCCGGACCT |
| TAGGTAAGAGATCT | GTCGAACCTCTGGT | TATTCCACGATGGA | TGTACGGTGCTACG |
| GCGTGAGACCTTAT | TTCTGAAGAGATAC | ATTGGCGCATATAG | ATAGCGTCTAAACT |
| CAATTAAGCATTCG | CATGTTACCAACTA | TTAATAAAGTCGAG | GAGTGTATTGGCGA |
| CGCACGTTAGTTCA | AATGATTCACTAAC | TCTCAAAACACCTT | GATGTACTCCTCAA |
| GAGTCCCACTTCTG | AGGCTTTAAGTCGG | GATTGGCATAAAGT | CTGTCCTCATCCGG |
| TACAATTAGCATGG | GGCGATACTTATAG | ATGGTGGATAGACT | AAGGAATTGTTCAA |
| CTCTCTCCCTACAG | GTTGCCCTCCGTAG | TGCGTCGCATGTGG | CGTTTACACTCCCG |
| TTTAGACCGCTCAC | CTAATAAATGCTCA | AGCTCCGTCCTATG | ATCGGTAGCCTTGA |

FIG. 7 (Cont.)

| | | | |
|---|---|---|---|
| CGACCTACCATTCT | TTCCACTAATAGCC | ATGTAAGAGACCTT | AGTAGTCAACTTGG |
| TTGAAAACGATAAT | TTCACAATGCGCAT | CGAGCATCCTCTCT | TCTCTAGAGTACCA |
| TCGCGTACGGCCTT | TCCCGTGCCATATG | CGACCGTCTTTCCG | TCTGCCATCGAGTG |
| GTACCGGAAGGTTT | ATAGATACTTCCGA | CTTAGTCCCTACCA | TTAACTCAGGCCTA |
| TCATAACCGTGGCT | GGGATCTGTAACGT | CTCAGAGTAGGGTT | TAGCTGGGGAGTTG |
| AATAGTCGACATAT | CTAGTTCCGAAACT | TAGCCACTTCCGCT | ATCCGTAATGCGGT |
| CGTATGCCATGCTC | AGTATGAACCTAAT | GTATCTTCGGACAA | TATATGACGGGTCC |
| GTTTGCGCGACTGC | GGGGCTACTTCTGA | GACCGTTCATAATC | GATCAGTGTACACT |
| AGGAATTTATACCG | TAAACGTCTTAAAA | TGATAGGAGTGCGT | TGAGTAAACTAATC |
| CTTGGCCGTAATGA | AAGGATGTCCGTCT | AGTCCTGTGCTAAC | CTCACCTCGATCCT |
| TCAACAATGGGGTT | CCGGTATAATTCAA | GTCCGTAGTTGAGC | ACGTTAATACCTGC |
| CACCGAGTACATTT | ATAGCGAATCGCTT | GGTGACGTCACTGT | TCCTAAGTAATGCG |
| GCCTGCACTTATAA | TGGATTTCGACACA | TTGTATCGGGCCGG | TAGTGCGCGACTAT |
| GGTGCCAGGTCCTT | ATAAGGTATTCAGA | ATATGAAGGTAGGT | TACGTTCCCAGAAT |
| TCATCATAGGTAGA | AGTCCTGGTCTCGG | TAGACCTGGCGTTG | TCCTTGGATGAAGC |
| AGGACCCTTTCGCT | AGACTAGTGTGTCG | AGATAGAACCATTT | ATCTCCATACACTG |
| AGGTACGACTCTTG | GGTGTACGTTGCAG | TTGTTGGAGCGGCC | CGGCCTATGTGCAT |
| CTGATATAGAACTA | GCCCGTGTTCGGCT | TTGCGGTCTCACGA | GATCCCTCTGTGCA |
| ACTTAGGGTTAGGA | ATATCCCTATGGGC | CCAACACTTTTAGC | AGCTTTGAACTAGG |
| GGTCATGGTCGGTC | GGTCGCGAGATTTG | TTCCACCAAATGTA | TGCAAGTTGCGATA |
| CTGGTCGCTTACGC | TTGATGAGAAACTG | CATATGACTACCCT | TATCCTGTCGGGGC |
| TCGGGCTTGTCCAG | CTTGGATACCGATC | GCCCGTTCAAGTGT | TAAAAACTACACTT |
| CAACGGCTTTCTCG | AAGTTTCGAGCTCC | AAGTGTAGCTTACG | TTGGTACGGCGTAG |
| CGTCATTCGAGGTG | AGATCCATAATATC | CACTCGTCCTGCTA | GTAGAAGTCTTAGC |
| ATCTCAAAATAGCT | ACTGCAATTGCGTA | ATAACCGTTAAAGT | CGATATCACGTTAA |
| TACTTACGAGGTCG | TAGTGCAACTCTAG | TCTCTGAAGGTCCC | ATTAGGATAGGTGA |
| AGCACGAATTTAGT | TCTGTGAAAACTCA | TCACAGGGCTGTTC | ACTGACCGATTTAC |
| CCGTGACTTGAATA | AACCGTCTCGCTCT | AAGTATAACCCTGT | CATAGATTGATCCG |
| GGAATGATCTGATA | TGTTGCTCGCGAGG | CCACTCCTCTAA | CTCTTGCTCAAGCC |
| TAATCAACGGTTAC | CCTCACCTCTAGTC | GTAGCCTTTCACAC | CTGCTTCCGTAAGC |
| AGCTTGTGCTACGA | AACAGTTTATACAA | TGTCTCGCGTACAC | TAGTACACTAATAA |
| TATAAACTGCGGAT | TTGCGTAGAACATG | CGTTGACTCCGAGT | CATTTGGCTAAGCC |
| CAGGCCCATAATTT | AGTCCAGATCCCTT | TAACTGGTCGCCTA | CCGTTACTCGCTAG |
| GCATTGGAGTGCTC | ATGTATGCAACATA | AAATCGGTTATGGA | CTCGGATTGCAGAT |
| GACTGCTCCTTACA | CAACGATTGTTCAC | ATGTATACCACTCG | CTGCCTAGTGGGAT |
| GCTGTGCTGGGATC | CAACTTGAATTGCG | CTTGTAAGATGACG | CACTTTCGGGCGAT |
| TCGTGACCGCTTCG | ATCGTACCACGTGT | GCCACGTTCCGATT | CCGTTTGGTGGGCA |
| ACGCTTCATTAAAG | ATTTATGGAACCGC | CTATGCGGTAAATG | GCGGGATGATTCTG |
| AAAAGCTACTATTC | TTCGGACCTACCGT | ATTTAGGTAAGACG | CAGTCTCGTGCTAG |
| TACAGCGCATTTCG | AGTCGGTTGATACC | ATGACACTTGAACT | ACTTGTCTGAACAA |
| TAAGTTCCATAAAG | CACCGTTAACCTTA | CGTTTATGACGAGG | GACTCTCGTATCGA |
| AATTTTGGACGCCG | GTTGGCTGGGCATC | CTGTACTACAATAG | AAGATTGATTACGC |
| CCTCTCTGGATCGA | TTGATCGCACCCAT | CTATGAACTAACTC | ACCTTAATTGGCCA |

FIG. 7 (Cont.)

| | | | |
|---|---|---|---|
| CCCTTCATACCCCT | CGATAAATGCATGT | CTTGAGATGTAAGG | TATAACAAGAGTTG |
| ATGCTTACTGACCC | AGTAGTCACAATTA | ACCCCAACCTTTTC | TTAGGTGACACTCC |
| GAGTCTAGTTGCAC | ATCGGTAATGGATG | GTTCCGAGAGATTG | TTTCACGAGCGGTG |
| GGCACTCTTAGCAT | AATGCACTGGCTGT | TCCGAAATTTCGCC | CCACGGAGGTTCTT |
| AATCATTCCCAAGT | GCTCGGTTAAGCTG | ACGGTAAATAATCT | TATCCCTTGAAACC |
| TGATAGGCAGGTTC | GAGGATTTCACTCG | TGGTGAGCGCTAAT | TGGTCAAGTGGTCG |
| ATCGGCTTGCTGGG | TGATCTGGGACTAA | GTGAGACCGGTTTC | GGGGTTTGTCGCCG |
| GTCTAAGTGAAATC | TATGACTTAGAGAC | GTACTAGGGATATG | GATATCCTAAGGTG |
| ACGGTGAAAATTTG | ACAGTCGAATCTTG | GATCGTCTACCGGT | AATCGCGCTAAATT |
| ATGCCGCTTCTCAA | TATCCTACGCTGCC | ATTGAATGTGAGGG | ATACGTGAATGCGT |
| AATTCGTCGAGGGT | GCTCGGGGTCCATT | TTGCGAGCTCTCCC | GATAACCTCTAGGT |
| CTCTATCGGGCATC | ATCAATCCTGTAGG | ATTTGCTCCAAGCC | ATCCTCAGTTCGGC |
| AGTCTCGCGAGCTT | ATCGACAGTCCGTT | CGCATCTGATGATG | GTATGGAGCGTTAC |
| CCCGTTGGCAGTAT | AGGCTCGTTAATGC | TCGGGATCCTGTCA | GACTCTTCGAGGTC |
| GAACTCTCCAATTG | GAGGGTTTAGGCTC | CACTAACTCTTAGA | GATCATAGAAGTTC |
| GGTGTCAATTCCGG | GTCGCTAGACTTAC | GGTTGTGCCATCGG | ATCCACACTTCTAA |
| TAATCAGGGTTGAA | GGATGGTGCTACCT | CCGCCATATCGATT | GTTCGTGAGAAAA |
| GTGGCGTCGACATT | ACGTCCCATTCCT | AGACCGTTGATCTG | TGGGGATAATTCCC |
| ATTGATCTCAACGC | TTAGAAGCCTGTAA | CCCCTCCTGTATGG | TACAGTTACTAGAG |
| CGGGAGCATCGTTT | GAATTACTCATGAG | CCCTTCAGGTGACT | GCCGTTAGCCATCT |
| ATATCCGGCTCCTC | TCAGGACTTATGGG | TGACATGGCCGTGT | CGAGGGTTTATAGG |
| CTGGACCCTCACTT | GGCACTATTATAGC | GAATAGTGTTGACC | ATCCTGAGTGCTCG |
| GGGTAGTCAATGTC | TCTGCGTGCGAGGT | CCATTGATGGCCTA | AACGTTTTCGGAGA |
| TCCGTTACCCCTAA | TGTTCACTACGAAA | TGACCGTATTGCAA | TTACCTCGGGGCGT |
| GCTAGCTCCTCCTA | TATCATCACCTCAG | GCTCCCCCAGTGTT | TTGAGGAGAAGTAT |
| TTAGGTGACCGCTA | TTATGGCCACATCC | AGGCATATTGTCGA | ACTCTATAACCTGA |
| TGCGTGCGACTCGT | TCACGTCTCGGCTC | TACGAAAGATTGTC | TTATCGCTACACAA |
| GAGTCCATTATGCG | CTCTTCATAGACGC | GTCTACACATGACT | AATCATCGGGTCGT |
| CTGACGCCCTCTGT | TCATTCGTACCGAA | ACCCTTTAACGCGT | TGGAGCACGTTGCT |
| CGTAATCAGAATAT | TAATCCCTGAAATG | AGCCATCTTGTACC | TCATTAGGTAAGAG |
| ATCTAGACTCTAAA | TTGACCGGCTCTCC | GCCCATTCATATCG | GCCTGCATTCCCTG |
| TACGTTAGGATGGG | ATGTTCGGTGAAGC | CTACCATGCTGCCT | TTTTGGAGAAGACA |
| CAGTATTACCATCA | GGAGCTAATTCCAT | TGGCGGAATTGTCA | CTTTCGAGAGACCT |
| TCCCTTACTCCACG | CTCTTGTCCCAGGG | AAGTTCCTTGAAAG | TGCTAGGTATCCCC |
| TTCATACGACTCCC | GCCGCACTTTATGA | ACTTCGCTACACTC | ATCGTCCGTTCCCG |
| CCTGGCGAGTTACT | GGAAGTTGCACGTT | CTGTTCATGAGCAA | ATCGCTCCCGTACT |
| AATGAACTGGTCTG | TTACAGAGTAACTC | GCCTACTTTAAGGC | TGTATAAGAAACGT |
| ACTTCTCCATACGA | TTGGCAAAATAATG | CTATGGCTCCACGT | GGCACGCTTGTACT |
| CTACATGATTGCCG | TGCTGGATGTCAAA | CGGCCTCAATTCCT | TAATAGTTGCGAAC |
| ATGGCTTCGGTAAC | TTCTTGGCGGGGAA | CACTGAAGCTTCCT | TCTATCATTCGAAC |
| CACCCCTTGTATCA | GGTAACAGATTTAG | CGATCTAAGTGTGG | GACTCCGTGTTACT |
| TGCACTAATAAATG | ACCCGCTTATCCGT | CTGTCAATGGGCTC | CTAGTAATGGTATC |
| GTCTGTCGTACCCG | CCCATTCAATGATC | GCCTCGTTCCTGGG | ACGGTCTATTCGTC |

FIG. 7 (Cont.)

| | | | |
|---|---|---|---|
| ACTCGGGTTGTCCT | TGTCCTACCTATCG | CAATTCCATTATGC | CGAGTGCTCTCCTT |
| GGCCGTCAGTTATT | TCTCGTATAGGACT | TCATACTGCTTGGG | GTGGATTCACATGT |
| GGTCATTATTACGC | TTCGCAGGAATTGT | GTTTAGTTCCCGAA | TTACTGTGGCTAGA |
| ACGTCGGTATGCTT | GGTAGATCGTATAT | TTCGGTGGTAAATC | ATTTAAAGTCAGTC |
| GATTGTACATAGTA | TTCAATTCAGCCGT | TCCTCCGCTCTGTG | CATCATCTTCATCG |
| TGCTGTCGGAATGT | GACTTGTATTCCGA | TGGCGTCTGTCGCT | TATAGAAGTGCATT |
| CCGGGTTCTAGTTC | TCTGTAGGGTGGT | TACTAGGTTCAATA | TCTGGAGTCTCGTC |
| ATACGATTTCATAC | CACGTATCACTTTG | GTATTAGGGAGTCT | TATCCACGGTGTGT |
| TGGCTATTCAAGAT | ATACATAACCTATT | CGAATTTAAAGAT | TATGTCCGGCTCAT |
| GGACGTGTGTATTC | ACCAAGGATATTTT | ATCCCTTGTAATCG | AGTTTATAAGGACT |
| TATGCGGTAAGTTC | TTTCAGGTAGATGG | CTGTGGCATTAGCT | CGAGTGTTTCGATA |
| CACGGCGTGTCTTT | TAGTGTATGCCGGT | TTATGGTAATGGAC | TGTTACTCAATAAC |
| ATATATTCCAAGTA | CAGGAGTCGGTTTT | TCAGTGTTCCCCCT | ACAGTTCCATCTA |
| TTCTTAATCCCCGC | TTAAATGCCTGCTC | TAATCGTGGGTATG | GTACAATGCCCTTT |
| GCATGGCTTGTTCG | TTAAATCCAGATTG | ATTATTCGTCACAA | TAAGTAGATCTATG |
| AGGCACACTTTTTC | TCTTCAATAACGAT | TATCGTAGCTGCCT | CCTAATTTTGGGGC |
| GCTCTAACTGTTGC | TATAATGGTCAAGT | TCCGATACTCTCCT | CTCATATGCGTAGT |
| GATAGGCCCTTCTT | ACCGTCGGTATTTC | CAGAACTTTAGTGT | GCTTGCGTCTGTGG |
| TGATTTGGGGATCG | AGAGTACTGTATTA | GCGGCAATTTAATT | AATGACATTACTTC |
| GATTCAATAGATTA | GACTATGGTCCTAT | ACCGCCATGTTTTG | CGTGAATATCCGTT |
| TTGCAGCGACTGTT | TAAATTCACAGTTG | GCTTGTGAATCATC | CGTTAGCGACTTTG |
| TATGCTGGATATCG | AATTATGCCGCTTA | TTTGTTACCGGAGC | TCTATTGTGCAGCA |
| CTACATAATTAGAT | CAAGCATTGCTCTT | GTATTCGACTAGTC | GATAAGAGGTTATT |
| GCTGTCTCATAGCT | TGGTGGAGTGTCTC | TTGTAAACATGTG | CGCTTCTACATAGT |
| CCGACTTACACTTT | GTCCGGTCAGCTTT | GTGGACTTCTCATC | AGGGTCCTTAGTAT |
| TCACTGATCAGTTA | TAGTGACATCGATT | GTCCGTGGTGTCCT | TACTGTAACGTAGT |
| GTTTGAGCGTTACA | AGATTAGGCTAATT | TCTCCGCTTTCCCC | CATGTTGAGATGGT |
| AACCTATGGGTTGT | CTCTTCTGTCCAAA | TTTTAGCGCGACTC | ACACATTTATTGCC |
| AGATGGCATTTTAA | GGTGTATGTTAGCC | TGTGCGATCAATCT | TCTGGGCCTTGCTC |
| TATCATGCATACAT | CCTCGAATTTGCTA | TCTGCTCATATAAA | GCAATATTTCTAGG |
| TTAGATATACGTAA | CCATTTATGGGTCC | GTAGTATCCCTGA | ACTAGTCTGATTCC |
| TGCAAGGCTGTTTG | GACGATTTCCTTAA | GATTAATTGGAGCT | CCAATGAAGTATTT |
| AGCTGGTGTTTGCG | TGTACCCTAGTTAG | TACACTCTAATCTC | GCGAAATATTTCGT |
| ACTCTATATCAATG | GCTTACCGATGTCT | TTCGGGATGGTTCC | TATTATCCAACTGC |
| AACTTCCCTTTCCC | CATTCATGGTGACT | TAGACAACTTTATC | TCTTTTAGCACCCC |
| GCGCACCTTTCTTA | GAAATGTGGATGTT | TGACTATCATACTA | TTTTAAGGATAGGC |
| GTTGACTTGCCTCG | TCTAAGTCATCCTG | GTAATGCCTGTCTC | CGTAACGCTGTGTT |
| TGACTTGCTAATGA | TGTATATGAACTCA | CTTTAGTTGGGCAA | CTAAACATTTCATC |
| GCCATTGGATTAAT | ACTTCCGGTTCCAT | TAATGCGTATATAA | GAAGTTCTACTATA |
| TTTACCCTGTGGAG | TTCACTGATATCAC | GATGCCAATATGTT | GCTGGTATGTTCGG |
| TCATGTAGTATACG | GTTGTGAGTGCCTA | AGTATTCATGCCTC | TCGGATACGATTTG |
| ACATACTCACTATT | GTAAGCATTGAGTT | CCTTCTCGCCTGTC | CTAAAGTTGTCTAC |
| AATCCGGGTTGTTA | AAGTTATGGATTAA | ATATGAGTGGTAGT | TCCCATTCTGAAAT |

FIG. 7 (Cont.)

| | | | |
|---|---|---|---|
| TGTAAATGCAAATT | CACCTACTTACTG | TGCACTTTATGGCG | ATAGCTTGATGGAT |
| TCCGATTACAATTG | AATTACTCTTAGGC | ACTATCATATGTGG | GTATCAATGGTTGG |
| TGGCCGTTTTCGAG | TGCTACTTGACCTG | CTTCCTTAGCACTA | CAAGTCTCTTGGTA |
| ATCAACTTCTGGGT | TGCTATGCTATGCC | TCAATTATCTACCC | GTTGATAGTTAAGA |
| TCAGCGGTTGTCAT | TAACGCTTAACATT | AGTCAATAAAGTTT | GTTAACATCCCTG |
| TATTTCATGCAGAC | TAGGGTATATATGC | TGTAACCCGTATTA | GGTCGAGACTGTTT |
| GCCTTTCCCGAAT | ATGACTTTAGGTGG | AAGTCTACGATTTC | TTGCGCGTATGGTG |
| TAGTTGGCTGATGA | GTCGCTTAAGGTGT | GCGTCCTCCTATCT | TTGCTGATCGAATA |
| CGGTACGTTCTCCT | TCAGACCTATTTGG | GGCAGGTTATGTGT | GGGTCTTTGAGAAT |
| GGGTTTAACGATAT | CTTTAAGCTGAAAT | GAGTATCATTATCC | ATGGAGGTATATTA |
| TAAATTACATGGAT | GTCTCTTGAGTCCG | TTTAGCCAGACGTT | AATTGCCTTATAAA |
| CGTTGGATGGCTA | TGCCGCTTGCATCT | CGCACTTTTAAGA | TCATGAGACTCTGT |
| AGGATGTATTATGG | AATTCTATTCACAG | TTAACTGGTGCGTC | TTAATGACTGGGCT |
| TGTATAGCGGAGTT | GTTCGGACTATGTG | CATTACTGTAATGG | ATTATGGCCTGCCT |
| ATCATTGTCCGACT | TCCTTTAAATCAAG | AATATCTGGCTATC | CTAACTTCCATATG |
| ATCTGGTAGTTCAG | ATCTAGGATTCCTA | CTTCTAGTGGCTGG | CTGCTGTATGAACT |
| GGATAGTACGTTTG | TGGACCTTTTGAGG | CATGTCATGCCGTT | TACGTCTGCGCTGT |
| CTTGCTAGCTGGTA | TGCATTCGTATCCG | CGGTTGGGTTTCCA | CTTGAGCGTTTGGC |
| GGATGTCTTTGGCA | TATGCCTGTACTAC | GGTGGCCAATTTAT | TAGATTAGTCGTAA |
| GATATAAAAGTGTT | CTGTGAATACTATG | TATCGGTCGCGTCT | GTCGAATGGATCTT |
| TTGAGACGTTCTCA | AGTAATCATTTGAA | GTCATGTCATGATC | GTGGCAGATTTGCT |
| TAGAAGAGTGTTGT | GGCTCTCGTTACTG | CTGCGAGTGCTTAT | CCTCTTAGAATCAT |
| TTGTTAACGTGGCG | TATCCTCCTCTCA | TACATAGTCTCATA | TTCTGTACCGAGTC |
| CTGAGTAGTGTAGT | TGTGTCCGCGTAGT | GGACTCGTCTCTAT | GTGGGTTTGAAGGT |
| TCCCGATAGTTCTA | CATCTCACGTTGTG | GGGGTACTGTTCAT | TCGTTACAGTCTGG |
| ATTCGAGTAAGTGT | TTACGAAATTTCCA | CTCTGTGCCCATTG | GACTGAGTGCTGTT |
| ATTTACCATAAGTG | AGTTAGGAGGTATT | ACGTTTGATATGAG | TCAATACCTATACT |
| GGCTCAGATTCTTA | GTCTTCCCTAAAAT | CATACTATATACTA | TGTTTGGGGAGGTC |
| GGTACTGGTTAGAT | TCGTTGCCACGTCT | TTTGGCAGTTCACA | CACTAACGTTGGTT |
| ACAGGAGTTATTCT | TCTCTGCCCTGGTA | ATCGTGTTCGACAT | TCCTACCTCATATC |
| AGTATACGATTACT | CTTTACCAAATTGA | AACGTGTCTCGTTC | TTGGTCGGTGCACT |
| TACTTCCAATCGTC | ATCGTTTCCCCCTC | GGACGTATTGTATA | TTTAGGTCTGGAAG |
| CTTATACTGTCAAA | GGACTATTAAGTAT | CAATAGTATTAGTA | ACTGTCAGTTGAAT |
| GTTAATGTCACCTC | CTAACCGTCGTATT | TGGTACCTTGGCTA | GGCTATCCTCTAAT |
| TTTCGGTCAATCCC | CGATAGTTAGTGTA | TACGATTTACGAG | CAACGTTCTCTGTG |
| GCTCCCTTTCGAGT | CTCCCGTTAAATTC | TTTCACTACACGAT | GCTGGTAACAATTT |
| TAGTACTCCCCATT | TTAACCTCCGATTA | AGATTCGCGTTCTC | TTACATATCAGCAT |
| CTGGTTAACCTAGT | CCTAACTGTTTGAC | GTATTTGAGTCACG | CAAATTTCCTATGC |
| AGCCTTGCGCTTTG | ATTGCGTACCTGTA | CAGTTATTATCGAC | GTATAGTTTAACCC |
| TCCTTAGACATTGG | CCTCTGTGTGATCG | ATTCGGTCGACTTA | AATTCCCGTGATTC |
| TTGCTGTCCGGTAA | CTCCCATTGTGATC | GCCTTTCCTGGCGT | TTGACTTAGATAGC |
| CTATCAGATTATCG | TGCCACTTAGTAGT | GTATCATCAGATCT | GACTCACTTTCGTG |
| TGGATCCCGGTTAT | AAATCAATTTGCTG | TATCGTTAGAAAAT | CTATGCGACTTTAG |

FIG. 7 (Cont.)

| | | | |
|---|---|---|---|
| GTGTCTACACTATC | GCGGCTTCTTGCC | TCGCTTCTGCAACT | AGTAGTCGCTGTGT |
| ATTTAGATACCTGG | TCTCCGTTGAGCGT | TTTATACAGCTAGG | TAGTAATGACTGTG |
| TAATTCTTCGGAGC | ACTTGCCTAGTGGT | TGCAAATTAGATTG | ACGCTCTTTCTCGG |
| ATTTCTCGCGAAAT | TCTCAAGTACTGGT | GCCTCTATATTCCA | TCGGCGTCTTGGTA |
| TACAGATGGTTCAT | AATCAGTTCGTATC | AAGTTCATCCTCTC | TTTAGGAATCGATC |
| TGAAACAGTTTAGT | TTACAAGTGTTCAA | TTGCCAACCTTTGG | ACGCTCATTCGTTC |
| GGCCTTTCCATGAT | TTTCCGATGTCGA | GTTTTCCGGACCTG | TTAGTTCGATACCC |
| TGTATACAGGTCTA | TCCTCGCAACATTT | TGAAAATTGTCTC | AATCGATGTATTAC |
| TCTTCTCGTCCACG | AACATGTTACTAGT | AGTACATCATTATG | TTAGATACACTAGT |
| ATTTTTCACAACCG | TTAGTGGAATTAAA | CGTTATCAGGTGGT | TACTCGGGATTCTA |
| GGGTGATATTGCTC | GTATTACTTGCCCA | TGGTTCATAGTACG | TCATCTGCGTGCAT |
| TTGCGAGGTTGACT | TCTATCTGCCAGAT | CGGGGTTTCTACAT | CTGTTAGCCGTTCG |
| TGTAGAGTTACAGT | ACCGATTGGTGTCT | TACCAAGGTTTAAT | GTATCTGTTAAGAC |
| CTTTGAGAGCATCT | TTACATCCGTATAA | CCATTACGTCCTTA | TACTGAAATTGGCT |
| CATATGGTAATGTC | TTTGTGCCCGATGG | CTGAATGTTAAATA | TTTCACCACCATCT |
| ATCGTTTGGAAGCT | GTAATTCGTCAGCT | TTGAATTATGCCCA | ACCTCGGTTGCGTT |
| GGGTTATCATTCGA | CGGCTCTGCCTGTT | TTTAGGCTGCACCT | TCCGAAGTTGGTAT |
| TGCTATGGGTCCAT | ATGGTGTGAGTATC | TGGTAACCCTGTTA | TAATGCCGTGCTTG |
| TGGGGAAATCTTAT | GGTTCTCATCCATC | ATCTCTATGAGTGC | TCCCACCATGGTTT |
| GTTCAATAGGTAAT | ATCGACTACGTTTA | CCTTCTTGATCGAG | ATCTGCTTCACAGT |
| ATAAATTCTGGACT | AGATCTTATGGTGC | GCAGAATATTATTC | GCTTAATGAAATTC |
| GATTCTGCCCTCCT | TTACTCAGCCGGTT | TGGCAGGGATTTCT | GGCTATATGTTCAG |
| GTCCAATCTATTAA | GCAGTATCAATTTC | GCTCCTGTGTCCTA | ATTGTAATTGAGCC |
| ATTCAGTTTACCGC | GTGTAATTCCAGTC | ATTCCTGATGGCCT | TTCTCCGTTGCCGC |
| CGAAATCTATGTTA | AGTCGATCTTTCAA | ACCCCTTATTGAAT | ATTGTCCCGTAGGT |
| TCGTCTGGGAGTCT | TAACCCTAGTCTAT | TAGACACGTTTTGG | ATGGTACGTTTCGA |
| TCGACCTTAGCGTT | TGTATACGTTCGGC | GTAATGATACTTCA | CTTGGTTGGCTCCG |
| CAAAGTATGTTTCA | GCATACTAGTCATT | CTTACGTCCTGTCA | CCGAGGTGTGCTTT |
| GTTGAATCCGTATG | GTCTTACCACCTTC | GCCTGTGGTGATTA | TACTAATCCGGTTC |
| GGCGTATATCCTTG | CTTCGACGTAGTTG | TGTCATATTGCCAG | TGACGTACTGGTCT |
| ACCTTTGCCTATCA | CTCGCCCATTTTCA | TGTTCTATCCAAGC | TTTCGAACCCTGAT |
| TTAATACGCGTCTG | TACTATCTCCCCAT | TCCCCTTATCTACA | CTTCTGCATCATCA |
| TACCGCCTGTGGTT | CTCCCCGTTATGCT | CTTCTAGGAGGTTC | GTTTTTGCCAGCCC |
| TGTCATTGAATAGG | TTTCGACGCTCGGT | ATTCGCGGTGGGTT | CGAGTTCCTTATCA |
| TCGAACTTGCTACT | CATTATAATAGCAT | TACATGTGGCCTTA | TAAGAATTTTGCGA |
| AGTATGCTTATACG | AATGGGTGTGATTG | TGACGTCCTCTTC | CAATATATTGAGTG |
| TACCATCTCGTCTA | TCAGCTATCATAAT | GTAACCTTAACCTT | ATTGATTCGGACTG |
| ACATTGTTAGTGAG | GCGATGTTAATCTC | ACTGATGTTTCAAC | ACCACTAGATTTCT |
| CTCGCCGAATTATT | TGTCCAGTCTGGTA | CATTTTCAGGAGTC | ACTTTACAAACTCT |
| GGTTACATGATCG | GGCTATTGATCTAG | ATGGTACGCATTTC | ACTTGACATGATGT |
| TTAAGGAGCTCCTT | ACTAACTATTGTGA | CTCGATGTGCTTCA | GTGATCTTTGCCGG |
| TAATGCCGTTGCCT | TCGGATAAATTACT | CCTCTTTACGCCTC | TGCGCGTTTGGAAT |
| AATCTGATGAGTCT | TAAGCTTCTCGGCT | GTTGTGCCTACTCG | AGTGCCTAGTGTAT |

FIG. 7 (Cont.)

| | | | |
|---|---|---|---|
| CATTTTCTAAGACA | TGATCCGATTCGTC | GTACTCGTATATCG | TCCTTCTCATGACG |
| ACCTGCGCAATTTT | TTTGGCGTTGAGCA | GAATATCTAGTTAG | CCTTACCTCTTCCG |
| CCCGCTAGTTTTAG | GGGTTCCGATTAAT | GGGCACTCGTTGTT | GCTGTCCTGTGTAA |
| GTACTGCACTTATC | TTCAGCTTTAAGCC | GTTTATTGGAGGGG | GATCTCGTATGGAT |
| TCCGAGTTCTTGCG | ATTTGGAGCTAACT | ACCTGTTGACGTTG | TGGTTTGTACGCAG |
| TGCGTAGTACGTTC | GGGCTTTCCTCTAG | CCTGATTAGTTCAC | ATTGGTCGTCCATG |
| CATTGTCGGATATG | TTCGTACTCACTCG | AGCTCTCTAAGT | TATACATTCCTACC |
| GGCTTCCTGAATTC | GATTAGTTTAGAAG | CTGGTTCAATGAAT | ATTCGGTTCGTGCA |
| ACACGTTTGTCACT | TGCTCGGTTATCAG | CTACGTCTATGTGC | TGAGCTGTGGTATC |
| GTGCTACTCCGTCT | TACGACCATTTCGT | CTCTGGGTTAGCTA | ACAGTTTAGCCCTT |
| AAATTTGGGGATA | TGGGATCATATGTC | TCGATAGATTCCCT | CAATTGTACATCCT |
| TATACTAAGGATAT | CTTATGCTGAAGGT | CTATCGTTCAGTGC | ATAACGGCTCTGTT |
| ATCCGTGTATGATA | TGTGACCTTACGCT | GGATTGATGATAAT | CTTTCCTACGTCAG |
| CTCAAATTATCACT | GTTGTTTAGAACAC | TACTGGAGATATCT | TCTAGTCCTGTACA |
| AATGTTGCATCTGA | CAAGACTTTATCTC | TTAGACCAATAGTT | TTGCGGGTGCGTTA |
| AGAAAGTTTTACTA | CTTTGGCTCCCTCA | TTGTTAGCTCAGGC | AGTTTGACTCTAGC |
| GCTTTTGAAGGAAT | TTTATATGGCAGCG | CTTTAATATCACAC | TTACATCAATCCCT |
| GCTTTCAGCTACTA | TGGTCCCTTGATGC | TCAGCTCGTACTTA | CGGTTAGATTGTAG |
| GCTTACTCTACAC | ATAGTCTGGTGTCA | GGTCTTGCGTAATA | GGGTAGCTTCATTA |
| TTAAGCTACATAGT | GCCACCTATTTTAG | ACAGGGATATTTTC | GGATACGTATTTGC |
| GATTTGGCGGTGCT | ACTCTGCATTGCAT | TTGATGCGTAGTGG | CCATTGGCGTCTAT |
| AAGTTGCCTGGATT | CCTCTGATTCATGC | GCTTAACAGTCTA | CCGATTGAGTCTTG |
| CACATTATTTGACA | ATGGTGTCTTGCCC | GGCTATACCTCCTT | TTGGAGTAGATCTA |
| TGTACCCGTCTATA | CAGATTTAGGCAT | CATTGTCCTCCGTC | ATTTGGACTTACGC |
| TTGTCACGTAACAT | CATTTCGTAATCCG | CCTTACGTGCTTAG | TGTCTTAGATAGCC |
| GAGATGAATTGTTC | CCTCGCTTATCATG | GCTTTAAATTCCCC | TTCTGACTACAGGT |
| GATTCCTTGTAAAA | TCAATTTGCAATGG | CCTATGTCTTGACG | CAATTCATGACTTC |
| TCAGACTGTTGATC | TGTATGTAGTACCC | GCTTTTGGGCCCTC | CACTTTGGTAACTG |
| GCGTTCATTTAGAC | CTACGTAACACTTT | GTGAGCTGTATCTA | TTATAGCTGAGACT |
| ATATTCATCGCATA | GGCTCGTTTGGTCC | TATGGATGTATGCA | AAGGATCTTTGCTG |
| CTCTGACTTTACGA | TGTTTTCAAAGGC | GATCTTCCGTGTA | GTTTTGACATACAG |
| GCTAGTATGACCTT | ATCCTTGTAGTAAG | CGTTCTATGGTCGC | TACTGTTGTGAGCG |
| TAGTGCACTTACTC | CAATGCTGTCCGTT | TGTTGGTTGCGGCC | TCAGGTTCTACTGG |
| CTTTACCATCTGCC | CTCGCTCTGTAAAT | AGTGTAGAGTTCGT | TACTGTGCGGGTTG |
| TGTCGCTAATGAAT | GTGGTTTGGCCCGT | TTCAGAAGTAACTT | CAGCGTTTTGCCC |
| GAGCTGAGTTTTGA | TTTCGCTGCTACCC | ACGGGTTTGTACTC | CTCTTCTCAAATAA |
| TTAGCATTCATAGG | CCCTTGGTTAGGGT | TGAGGTTCTCTAAC | CGTGCTGAGTTTCA |
| AATGGTCCTTTACG | TTCATAGGATAATC | CTCCTCCGGGTCTT | TCCTTTCCCGTAAG |
| TATGTAATGAACTC | TAACTTGTTACCAC | ATTTTCAGGTAAGG | GTATGGTGATTCGG |
| GTGGGTAGTCATTG | TGCTGTAACTGTAA | CCCCCTATATCCTT | GTAACGTTTAAGC |
| CGTATGTCGTCCGT | CAACCCTCTGTTGT | TGCGTGTGCGATTC | GAGTTTAGATATCA |
| GTACTGGTGTGCAT | CCTCGATGTTCGCT | TAATGCGTCTGCTC | GAATTTTTGGCAAG |
| TGACCCTTGTAGTG | TCCGTTTACCAGGT | CCTATCCCATATGT | TTGGAAGTTCGTGG |

FIG. 7 (Cont.)

| | | | |
|---|---|---|---|
| GATTCTCACGTTGG | GGGTCTTCTCGCTA | TCACCATTATCGTA | TGAGTCACTTAAAT |
| AGCTTTGTTAGCAA | GTGTTCACTGGGAT | TAGGAAGTTGATTA | TCAGCCGTTCCTGT |
| GCCTACTATATATG | CGTCGGATTCTATG | TTGGCAGGTTACTA | CTCGAGTACTTGGT |
| AATTTTGGCATCGA | TTAGCTTCCCAGTG | ATTCATTGCTGGGC | TCATGTAGTCAGTC |
| ACATTGGTTACTAC | ATAAGATGTGCGTT | TCGGATCGTTATGA | CTTACGGTTAATGG |
| AACAATGCTGTTCT | GCGTGTTGCATATC | TTATGCGCTAACGT | CGTTGATTACGTAC |
| TGGGTTAGAATGTA | ACGCTTGGTGCCTT | TGTGTTGAACGCGT | GTCAGGCCTAGTTT |
| TGCCCGATGTTATC | CAGTAATTGTTACG | AGGCTTATCTGCTG | AAGCGCTTAGGTTT |
| ATTCATAGGGTTAC | CGAGAAATTTGCTT | CGTTCCCTAGTGTC | TGGCTGAATGTTGG |
| CTTCATCTTGACGA | TTATAGCGTTCAAG | TGTGGTTATACCAC | CGGTAATTGGATTC |
| ACTATATGGAGGTT | GCTTAAATGCTTCA | GCCCTCTCATCTTC | GTACCAATTTTACC |
| ATAGGTAATGTTCA | TGATTACTGAGGTA | CTGTTAAATAGTGC | CTGTGGATCTCAAT |
| CTACGTGGGTATGT | GCAATATTGCCGTT | CGTCGTAGTTAGTA | ACATTGCCTCGTG |
| CTTCGGTCACTATA | TTCGGTAGGTTGAC | TGTTGACTACCCTG | AGACTCTGTTGCTA |
| TGTAGCCCTTTAAG | TCCCTGGGTTCCT | CCTAGCTTCTCTCC | GTGTTAGCTTACCA |
| GAATTTGCGCGTTC | TTCGAAATATAGAT | CAATTTGATTCGAC | TATTTGCCATGCGA |
| AGGTGTTTAGCAAT | CGTATATTGATAAC | TGTGTGTATGAGAA | GCTTCATTAGGTGC |
| CGTTGCTGATTCAC | ACTACCCGGTTTTA | ATCTGTCCTGCCTA | TAGATCAGGGTTTA |
| CATCTTTATGCGCG | TCTTAACTTCGAGC | TAGAGGTTTGTCAC | AGATTAACTGTCC |
| TAAATTGGTGTGCG | GGCTTGATTAATCA | ATATGCGGGTTTCC | CGATCTGTTGGATG |
| CTCCTGAACTATTC | AAGGGTCCACTTTT | CAATATTGCAATAT | TAAATGGCCCTATT |
| AATCGACTCTCTTC | GTAATAATGTAGTC | GACACTTACTTTCA | TTATCTCGGCACTG |
| TTCAATTTGCAACC | AATTTGTCAGATCG | CATCTTACCATTGC | CAATCCTATGATTG |
| ATATTAGCTCTGCG | TTTTAAGGTGGCCG | GAGTTTGAATTCAG | ATCAAGATAGTTTG |
| GACTTAAGGTTCTA | TTTTCGCACGTGAC | TTCAGATCGTCGTA | ATTTGATTCGAAAA |
| CCTCTTACATAAA | GGAGTTATAGTTGA | AGCGCCTTCTGTTC | CGAGGTTGTCTTCA |
| GTAACACATTTATG | TTTACAAGTATCCA | ACGGTCTTGACTGT | TATCAGGATCGATT |
| TGATTAATGATCCG | CGGTTCCAACTCTT | GGAAGTCTCGTTGT | TCTAGATGGCATGT |
| CTCTACTGGTGGTG | AGGTGTCTCATATA | CTGATAGGTTCATA | TAAAATGGGTTCTG |
| ATTTTGTGCGGGCG | TACACTCTATGAAT | CATCGTATTGTAGC | GAGATTGAATGTCT |
| CCGGAGATTTCGTT | GGGCCATTAATTTC | ACTGCCTTCGGTGT | TGCTGATTCTCACG |
| CTCTTTTGACAAGC | GTTCCATACTCAC | CCATTAAGTTATAC | GGATCCATATTGAT |
| TAATTGGATGACAT | GTTGATCTACAACT | GTGTTCGGCCTCTG | TTGTACTCGCTAGC |
| AGTTCCACGTTCA | GACGAATGTTCTTA | TTGCTGTTACGCGG | TCATTCCCTGTCCG |
| CGTGTTGTGTCAGA | TCCTACCTTAATCG | GTTTCGTGTACAGC | TTCAGGGCTTGGTG |
| AGTAGTTTTGGGAA | TAGGGTGATTACCT | GTTCGCTCCCTACT | CTGATTCATGCGCT |
| TTATGAGGGTCGTG | ATGGAATGGTATTG | AACATGTTAGATTC | GACGCTATTGGCTT |
| TGCGAGATCTTTGC | CCATTTACCTCCGT | CTCACCATTATATG | GTGCTTATCGTACC |
| TAACCTTTCGATCG | TATGCTATTGGAAG | TTGGATTCTAAACG | ATAATGTATGGATG |
| ACTCTGAGATTATA | CGTGGTTGGACCTT | TGAATTGAGTCGGT | CACTCTAAGTTTAA |
| TTCGCCTCCGGCTT | ATACTCTAAAGGTT | CACTCTCTTGAGGT | CAATTTAGTATCAC |
| CCGGTGTTACATTC | ACTATGGGGGTCTT | TCGTTCTATGCGGG | GTCTTCGTAGCCTA |
| TCGGATCATTCGAT | GATTACTCCGTAGT | GCTTCCATTCACCT | CACATTGTCTTAAG |

FIG. 7 (Cont.)

| | | | |
|---|---|---|---|
| GATTCATCTATGGC | AGTGTCTCGCTAAT | TGTTACTCGCCCAT | CAATTATCGTCTTA |
| ATTTCCTCGCCATA | ATGCTTATAGATGA | TGATCATATGGCCT | CTTAAGTCTCTTCC |
| ACGTCTACGTTAAT | GGTTGCGCAGCTTT | AGTTCGTCCTACAT | ATTCTACCGATTGT |
| AGTAAGGTTATCTC | CCAATGTTCAATCT | GTAGAAGTTTATAG | TAGTTGCTTCTCAG |
| CCTTCTATAATGCC | GAAGACTTTTCCAT | TTGGTACTAGAAAT | TATCTCCCTCTTCA |
| GCTCCCGAATCTTT | TGTGTACGGGCTTG | TAGTTCATAATGGC | TTTCCTCTAGACAT |
| TTGTTTCCAAAACC | ACCTATTAGTCTAA | TAGCTGATCTGTCC | TTATGCTATCGTCG |
| TTGAATTGCACGGT | AACTCATCTTTCGA | CAGTGTCGGCCTTT | CCGTATTTCCGTAT |
| GTCTTGGTTCAGAG | TATGTATCCTGGGC | TCTTGGGCACGGTT | GGATTTTCCTCAG |
| TAACGTGGCTTGTC | AGAGCTTAGAATTT | AGACTTGCTTACTG | GTTGGTCGATCTCT |
| TCCTTGTCTGCGCC | TTAGTAGCTATAGC | GGTATGAAAACTTT | TCTCTCCGTCCTGT |
| ATTGCTGTATGGGA | AGTCGGTTCAATGT | GTCTTGACCGTAAT | ATTCAGCCTTTAAT |
| TTGGATTCAACTAA | CGCCCTATGTTTCG | AATCTTGATGACTA | CTCATTATTCTGGC |
| CCTTTCATACTGGG | GTTACGAAAGTTAT | ATCGCAGTTTATCC | ATACTTCTCACGTT |
| CGAGGCTCTATGTT | CTGCTTGTATCGCA | CCATATTGAATTCG | TTTGCTACGTCACT |
| GTCTACTTTGAACG | ATCGAGAGCTTTCT | TGCTTATACATCAA | CTTTCTCTGACTCG |
| GCAAATATGTGTTC | TTGATCGTCACATG | CATGTGACTTTCAG | GTTTTATACGGTAA |
| GAGTCTAATTTAGA | TCAATGTCTCAATG | ATTGAGAAGTCATT | GTTAGATGTGTTGA |
| TCGGTTTGACATAA | GTTGATGTGTGGCG | AATCCGGATTTGCT | TGAGTGATTTAGTG |
| CGTCTTGCTGGTAG | ATAGCTTCTTACAG | TCTGTCCTGACGTG | TTTACTGAACTTGC |
| TTGATTATAGCCCG | TCTAATCTGTAAAA | ATGTGCAATTGAGT | TAATGGTTGCTTGA |
| TAATCTCACGATTC | TGGGGGTCTATTCA | AAGATGTGCCGTTT | TCGGTATTGGCTTC |
| CTCTGTCCGTGTGG | TGCCTGGTATCTAG | AGAGTTGCTTCTAC | TGCATTAATACTCT |
| ACTCCATTCGATTC | CATCTAGTATGTGA | ATGCTTATATCCAC | TTCTATCTGTCGGA |
| TTGCACGTGATTGA | TGCTATGTAATAGA | ATCATACTAGTATC | GGTATTATGGGTCT |
| CTTCACTATCGAAT | CACTAAGTCATTAT | GGTTCTGAGGTTAC | CTTTCGTGTCTCAA |
| GGCTACATAGTTCT | TTCAACGCTACCTT | GTGTAATTCGCCAT | TTGCTCCGTTGGTA |
| GGTTTTGTGGCACC | CCTATTAAGTGTAC | CGTTCAGAGGCTTT | GATGATGTTAGGTT |
| TTGTGTATAAGAGC | ATGGGTCTCCTTAC | TCGTACTATAAAGT | CTTCATGCGCCTTT |
| CGTGCTAGATTGAT | TTGCACACGCTTCT | TTTGCATCCTAGAA | CTGTATTCCTTGCC |
| CTCGATTCCTGTCG | TGGTGCTAAATCTA | CGGTTTACGTTAGA | TGTAGTAAATCATT |
| TTATCAACCGTCCT | ACTTGCACTGATTG | TCCGTAAGATTCAT | ACTGGGTTATCTCT |
| CTCCTGTGCTAGAT | GGTTTGAATACGA | GCGATACTTTCTCC | GTCCGCTGGTTTTA |
| CTTGCGTATTAAAA | TTGGCTATCGCCAT | CAAACTTGGTTTAC | ATGATTTGCTACAT |
| CTGTCACTTGTAAG | TGTTAGATAAGAAT | TGTTGCAGATTGCA | TCTTCCCCTTAGAT |
| CATGCGTATGATGT | TAATCACTGATGCT | CGGTTTGATCTCGC | TATTCGTCTGCGAT |
| TTCAGCGCTTCTGA | TGTTTACGAAAATA | AACTCGTAGGATTT | TTCGGTATTCCACT |
| TTTCACCGGGTATA | TGGTAATAAGTCGT | AATTGCTCTAGGTG | CTAGGTTTTACAAT |
| TCAACCTGGTTTCG | TGTAGATGTCTACG | TCATCATTTGGAAG | AGATTTCGTTCATC |
| TGGGGCTCCTAATT | TTGCTACTTAAGCC | TTGCGCTTATCCCA | CCTCATGTTTGATG |
| ATCTATGTGAGAAT | CGACTTCCTTTCAC | AATGTATTCTGAAG | CATGGTTTGTAACT |
| GATGTTCTCGCGC | TAGCCTTTATCGCC | ACAATTCTTCTTGC | GCTACTTACTCTG |
| ACACCTTGTGTGC | ACTAAGCTTGTCG | AGCTGAATATTTA | TGCACTTCCCTATT |

FIG. 7 (Cont.)

| | | | |
|---|---|---|---|
| GCTGGCTTTGTGTG | TTCAATGGCCATTT | CTATGTTCTCCAG | ACCTTATCATGCTT |
| TTAATCTTAGGTAC | TTCTTACCCTTACC | GCCTTTCTCTCTAA | TGTTCTATTGGGCA |
| TTGAAGTCTTTAGG | GTTATTCTAATGGC | TCTCTTCGACTAA | ACGCTTACTTTGTG |
| GTGATCGGAATTTT | TTCTTTCACCGTGG | GATTTATCGCTCTG | GGTGCTGTCGTTTA |
| TAGCATGTTTTGCA | GGTTCCTTAAGTCT | TATCTTAATGCTGC | CACTTTATAGTTCA |
| TTTCTGTGGGCCGT | CTTCAGATATGTTA | GGTACTTGGTCTTG | TGCTTTTGGAAGA |
| TCCCGCTCTGTGTT | TTACTTAGGTCCAT | TATCTGTACAGTGT | ATTGCCTGCTTCTG |
| AGCCTTTCGTATAT | CGTCTTGTCCTATA | TAGTTTGAACTGCT | AGGAGTTCGTTATT |
| ACAATTCCTTGCTT | TGGAAGTTGTTTCA | TTAACCTTGTTCGA | ATACTTTTTCCAAG |
| TGTGGCATTTGTGG | ACTTAGCTCGTAT | CACTGTACTTGCTT | TCGATTGTGTTAGC |
| TAATGTTCTGATGC | ACTAGAGTTTATTC | CGTGTATAATTTGG | TCTCTGGCGGTTTG |
| TCCGTCCTTGTAAT | GCAGTTGTGTGATT | ATGTAACTCTTTCC | CTTCGCATTCTTGA |
| CATTTGTGAGTTGC | GTTTATGCCACCT | ATGGTCTGTCATGT | GTCGTTTCTTCAAC |
| TATGTGTCCGTCTC | ATGAGATTCGATTT | GTTAGGTTGATGAT | TTCCATTATTCACG |
| AGTGACATGGTTTT | TGCACACTTTATAT | TAGTTTAGTTCGGG | AATGTCGTCTATAT |
| CTGGGTCTCTTGTA | CTATGATCTGTACT | TGTGTTACAACTAT | ATTTGGTATGGGGT |
| TTGTAGAATGATTC | CGCTTAGTTGTCGT | TGTGAGGATTATC | GTCAAGTTGTTCGT |
| TATTATATGGACTA | TTTTATTAGCGCGA | TTTCGCTAAAATTC | TCGACTTTATACAT |
| CGGTGGTATCTATT | ATCCGTTCTTCCAT | CATAAGTTGTTGTG | TGTCTGTTCCGATC |
| CTTTTTGACTAACC | TCCTGCCGATTGT | CTTATTGGCATATC | TATACATGTGTCTG |
| ATTACGCTGGTGTT | TATCGCTAGCTCTT | TCGTCTTATGGATA | GTGTGCTAACTTCT |
| TATTTCTAAGAGTG | CGATCCTTATCTTA | TAGAAGTACTCTTT | GTCCATATGCTTTG |
| TTAGTCCTGTCACT | ACTATAAATCCTTT | CTGTTTCCACATTA | TACATTGCTTGTAG |
| ACTGATTTAAGTAT | ATATGTAAGGTGTT | TTGATAGACTGTTG | CCCTTCCTTTCATG |
| CAGCTTTTGGCTTA | GGTCTGGCTCTTCT | CTAATGTTTGGAG | ACATTGTACAGTT |
| GGCGTTCTTTCACT | TTTGATCAGTAATG | CTAGCTATTTAATG | GCTTGTTATAACCT |
| GGTATGTTCGTGTC | TAGATTGGTATATA | GGGCTTTTAGGTG | TTGGTATGGATGTG |
| ATTCTGTTACGTAA | CTGTTACATGTCTA | GGGTTACTGTCTG | AATGATTTAGTGTA |
| CATGATCAATTTCT | TAATCTTACTTGGC | ATCTCTCATTCTCC | TTTTCGTAAACATG |
| CTATGTTAGTTAAC | CCCCTCTATTTATC | TGTTTACACCATGT | ATGAATTAGCTTCT |
| TCCTTGTCGTAGAT | TCGTATTGTTACAC | CTCTCTTAAGCTTC | CTACATTGGTGCT |
| ATTGTCGTGATAGT | TCATTCGATCTCGT | CACGATGTTTATTG | ATTGTGGTGAATTC |
| TGATATTAGCACTT | AGATCTGACTTTAT | TATCTGCGTGGTAT | TCTATGAATTAGCT |
| TCGTGGATTGATAT | AGTTTGTTTGAAAC | TTTAGTATCGAATG | TTACTTTCCATCGC |
| TACTTGTTGATACG | AAGTGTGCTTCATT | TGATGATCACTCTT | ATCTGTTGCGTCTC |
| TTGATTGTGGATAA | TTCCTGTTATCAGA | TCTTGAGGTGCTTC | AGCTCGTGTGTTAT |
| AGGGTGTATTTAAT | CTTTGCCCTGTTCA | AATTTGGCAATTAT | TTCGACGATTATG |
| CGTCGTGTTACTAT | GCTAGTGCTCTCTT | GGCTTATTCAGCTT | TAAGGTTGCTTTGG |
| TAATATCTTAGCGT | CTGCTGGTTAAGTT | GGTATGCTCTGTAT | CGCGTGTTGCTTGT |
| GGAGATCTTTTGGT | ACTGCATTTTGAG | TTTAAGGGCTTTCA | CATATAGTTGGTAT |
| ATATCCTTCATGCT | ATGATGTTGGTTAC | CAACATGGTTGTTT | TTTCTCACCTATAA |
| CTTAGATCTTAGTG | ACACTTTATACTTA | TTTATGTAGAGAAT | TGTACTTTTAACGC |
| TTATTGTACCACTG | ATGTTTCTAAAGTG | GTGAATGTTCATCT | TTGGTCACTTTCCG |

FIG. 7 (Cont.)

| | | | |
|---|---|---|---|
| GCAGTGCCTTCTTT | TGTGTTGACATCTC | TTAAGTCCGTTTCC | TTATGGCTCTTCCG |
| ATTATCATGTCTAC | TGTTATATAGCTCC | TTTTGCCGTGCAGT | TGCTGATTTATAGC |
| CACCTGTATTTCAT | ACTTAAGTCTTTGA | ATTTCTGTCCAATA | TGGATTTTACAGTC |
| CTATGTTGAAGTTC | GCTGTCTGGATATT | TGAATTTTACGTGG | TTCTCGTCAGTTGG |
| CTGCTGTGCTTATA | CTGTTAATCAGGTT | GGTTAACTTGGATT | TAGATCGTTTGTGC |
| TTTCTGACACCTTG | AAATCTTCCTGATT | TCCATATGTTATGC | TTGCACTTTAAATC |
| TAGCGGCATTTTTG | GTAAAGTGGTGTTT | TACATATTTCTCAA | CTTTACCTGTATAA |
| CATCGGTCTTCTTC | TATCATCCTGTGAT | CTTAGGGCATATTT | TACAACGTTCGTTT |
| GTTACTAATGTGTG | CTTAGTGCCTTTAC | CCCATTGTTTCCGT | CGTTATATACTCAT |
| GATTGATCTAGTCT | AGTTCTCTATATAC | TTGTTGGCCTTCGA | TCCTTTATTGACGG |
| GTAGTTATGATTCG | GGCTAATTTTTGCA | TGTCTGCACCTCTT | TGTGGGTTCTTCAA |
| TTTTCAAGTGGATA | ATTGGCCGTCTTAT | TTACTTGTATAGAC | TGCCTCGTCATTCT |
| TCTATTTCATCAGC | TCTCCTTCTTCCGA | CCTAGAAATTTATT | TGTTACGTTTCAGA |
| GGGCTTCGTTCTGT | CTTTTCAGGCACTT | CTTGATCTATTAAG | ATCTCATACTTGTC |
| TTTGTCCTTACCGC | GTGGTTTAATTGCG | ATTTTTCGTGGGAC | TGTTAGTTCGTCCG |
| CATGTCTCTTTAGC | AGTGATTACTTCCT | CAATCCTGCTTTCT | TACCTTTATAGTCG |
| TGTGTAGTGCCTGT | CTAGTCGTGTTTAA | CTTCATTGTAGATA | ATCTGGATAATTCT |
| TACATATATGTGGT | CATACTTTATCTGC | TGGCTTCAATCTTA | CTATCGTTTGCCA |
| GGTTCTGTCTGGGT | ATTGTATGATCAAT | ATTGGTAATTCTGG | AACCTTTTTGGCTG |
| GGAGCTTATTGTTA | GTTAATTGGACATT | CTGTTCCTTATACC | ATCTACATGTCTCT |
| TGTGCTTATAGACT | CCTTTGGATATCAT | CACTCTCTTCTTCC | CATCTTTGACATCT |
| GCTATTCTTGGTGA | TAATTCTGGCGCTT | AATTCTTTCTGCAC | GTACTTCCTAACTT |
| GATTATCGTGCCTT | TCGTTATCTCCAAT | AATTACCACTTTGT | CTATATCAATTCTA |
| ATTACTTTCTAGCG | GAATTTTACTGCC | CTATTTCCTGTAC | TTAGATGTTCACA |
| ATTTCGTGGAGTTG | TTGGCCCTGATCTT | TTGTACGTGGATTG | TAGCATTGTCGTTC |
| TTCTTGGGCCTACT | TTGCCGGTCATTTC | CCCGAACTTTTATT | CCTTGTCTGCTCGT |
| CTTTGATCTTCAGC | TGACGGTTTATCCT | CTTTCCAATTAACT | TTAGCCGTTGATTC |
| AGCGATTCTTAGTT | TGGTGCACTATTGT | TTCGCTTCGTACTC | AACTTACTAATGTT |
| CATTCTCATTGTGA | GTCCTACTGTATAT | CTTGTTTGTGAAAG | AGACTTCTTTACA |
| CTTTCTTCTGAAGA | CCGATACTTATTAT | CTCTCTCCTTCAGT | AGTTCTAAGTCTCT |
| GGCTTTCTAGTGTG | GTTTCCTGCGCTGT | GCTTCGTCGTTGTC | TGGTTTTATAGCGA |
| TATGGAAACTCTTT | TTTAACCTCCTGTA | GGATCTAAGCTTTT | CACTTCGTTCCTTA |
| TGTTAGATGTGGTA | CTTTTCACTCGGA | TGATATAGTTGTAC | TCATCAGTTACATT |
| TTGCATTGGTCCTC | CTTTAATGATGGAT | CTTACCGTGTACTT | TGCGTTTGTAATAG |
| GCGCGTTTTATCAT | TCTAGTTAACTGTC | TCATTAAATGCTAT | GGATATTAATTCAT |
| CTAGATTGTCTGTC | ATCTTGTTCGGGA | TGTTTGCCAGTAAT | GAGTCTCCTGTGTT |
| CTAAAGATCCTTTT | GTTAGTAATTTCAC | ATCTTTATGATGAG | AATGTATGGCCTTT |
| TCGTTCTTGAGCTC | GTTTGATAAAAGTT | ACCTCTTTCCTCAT | TGCCAAGTGCTTTT |
| TTATTCAAGTTGCA | TCCATTCAGGTATT | CTTATTCTAGAGC | ACTCCTTTGTTCCG |
| GCCGTTACGTTTC | GGGTCTTCTTAGGT | TGTTGGTACTAAGT | GAGTACTTTGATAT |
| TCGTTACTCTCGA | TCCTTTGCTACAGT | TCCGTTATAGTTAG | CATCTTTCTGTCGA |
| ATCGTTCCTTGGA | ATTAGGTTTAACTG | AAACTTGATGTTAT | TGGTTGCGGTTATA |
| TATTGCATCTCACT | CTCGATTATTCTGC | ATTCGTGAATTTCA | TTTACTTAACGGAT |

FIG. 7 (Cont.)

| | | | |
|---|---|---|---|
| TTGTGAGTCATGCT | TCTCCTCCGCTCTT | TTGCTAGTTATAAG | TTTTGGGCGAAATT |
| TGTTGATGCCTTGA | ACTTAGATTCGTTA | TTGTCCTATAATCA | TACAGTTCATATGT |
| GTAGTTTTAGCTCC | TCAGGATTTTAGAT | GGGCTCGTTACTT | GTATAGCCTGATT |
| ATTCATTTGAACCT | CTCTTCCTAGTGAT | TTATTGAAGCGATT | CTTTGAGCGGTCTT |
| GTCCCTCTTGTTAG | GTATTAAGATGATT | TTGGAGTATACTGT | ATTTGCTTAACTAC |
| CTTTCGTCACTGGT | GATTGTCTTCTGCG | AAGTTACTATCTTG | TTTCGCTTTCCACC |
| AGCTATTAGATTTG | GTTCTACCGTTCTC | GCTGACGTCTTTTC | AAGTATCTTGTAGT |
| TATGGCATAGATTT | CATATCTGAATCTT | TTGTGTCTAACCAT | ACAGTGCTTTTTCA |
| GTTTGGGGGTTGG | TAGTCAATTAAGTT | GTGTTCTGATGTCG | GTTACCAGATGTTT |
| TTGTAGGTTACTAG | GATTTGTTGCCAA | CCTTCTAAATCTTA | GTTTGCTTCAAATG |
| GTCTTGCGCGTTTA | CCCGTTATTATAGT | GTGATTTAATACTC | TTTTGCTTACCGGA |
| ACGTATGTTACTGT | GCTTTGTAACTGTG | ATGGCTAGTTGATT | TAATTCATCATCAT |
| TCCTGATATACTTG | ACATTATTTGAGGT | AAGGCTCTTTATGT | CTGTTCTGCCTTCA |
| GTTTCTAAATGAC | GCTTTTGGCGTTCC | ATCTTTTACGGGAT | GGGTTAATTTATGG |
| AAAGTAGCTTATTT | ATGCGTCTTCTACT | CTGTGTAATTGTCG | ATTGAATTCTGGTA |
| TGTGTGAATGTACT | TTTCTGACATTAGC | TAATTAAGTACCTT | TTTCGCTACTCATA |
| TTCACTGATTGACT | TTGTGGCCTCCTTG | AAGTTTGATTCTCA | TGGTTTTATGAGCC |
| GTTTACTTTGGCGC | ATCTTAACGTTGT | GATCTTTCTGGCA | GTATTATCAATCAT |
| AAGGTAATCTGTTT | CTGTTCTCAATCTC | TAGTTCATCTATGA | TTCTCCACTCTAGT |
| ATGAGTAGATTTG | CACTAGTTTACGTT | AGGTATGTTTCCTC | GTCATTGAGTTTAC |
| TTTTCAACCCTATG | TTCTGCATGCTGAT | TCTTGCTGGCGTTC | TCTGTTTGCAAGTA |
| TCCATTCGTGATAT | AGCACTCTTGTTTA | ACTTGTTATTGCGC | GCTTTTCGCTGAA |
| TGAATCACTCTGTT | CTGGTAATTTATCA | CCTTGGCACGTTTT | AGCTTTGTGAGTC |
| TTTGTGGAATAGTC | TTGGGGTCCATGTT | AGTTGTGATTACAT | GTATTTAACCTGG |
| GTACGTTTTCACCT | CATATGGTCTATTA | TGTAATTGCATTAC | CTAGTTTAGTTCGG |
| TTCTCGATCCGTTC | GTAACGATTTGTA | CCTTTTGCTAGGTG | TGGCTTCTGTTAAG |
| ATTTATGGTGGTGA | CTGTCGTTATCTCC | ACAGCTCTCTGTTT | GTGATGTCCTTACT |
| CTTAAGCTTATTAA | GTCGTTATCGCATT | GTCTTTGGTGAGGT | TTTTGATCCGAGGT |
| AGATTCTGATGTAT | CTCCTTTTGGCAAT | ACGCATATATATTT | TGAGTTTACGTTCT |
| TTTAAAGGTATGTG | CGTTTAAATTCCC | GCGATTTATTGGA | GCTTTTATTGAATC |
| TTGGTTCGCACTAT | ACGTTCATTAAATT | TTGCTACTTCCATA | CTAATTTTAGTCTA |
| TAGTTCTCATAAAT | ACTTGTTTACGCCT | TACGTGGTCATTTA | ATAATGTCGTTTTG |
| ATATTGTACTTCGC | CTCTATTCAATTGC | GTACTTTACATACT | TCTAATTCCGTTGT |
| CTAGCTGTCCTTTC | AGCCTTGTTATGGT | AGCATTGATTTATA | TTACGTTTTGTGGC |
| CTTTATGGCCGTTC | ATGACTCTGTGTCT | TTCGTTGGCGTATA | AGGTTTTTGCTGAT |
| TGGTCTTAACTTCA | TATCTTGAGATTCA | TGTTCATTACACCT | TGGCTTTGTCTCAT |
| CATTCTAGGGTTCT | ATACTGGCTGTTTA | CCTTTAGATTATGA | CTTCCCCGTTTTTC |
| TTTGCATCCACTTG | TTTTCGCTGGTCGG | TTTTCGATCGCTCG | GTTGCTTTTCCCA |
| GTATGAAGTTTTCG | ATTTCGTGATATGC | ATTGAGCCCTTTTC | CCCTATTGTGTGTT |
| TTTACAGTTCATCA | TCCGTTTCTGATGA | ACATTCTTTCACTA | CATGTTCGTGTATT |
| TTTAGATTCCCAAT | CATATTGCTTTCCC | GTTGTCCTCCTGGT | CTACTCTTTAATTA |
| TTAGCTAGTTTGGA | AACTCTCTTAATTG | GTATTTGTTACCGG | CATTGTATCATTTA |
| TCGTGTCATTAGTA | TGACGTTGACATTT | TGTAAGGTTTCCAT | CGTGTTCTGTGGTT |

FIG. 7 (Cont.)

| | | | |
|---|---|---|---|
| GTTTTCCAGTCTGT | TGCCCTGTTGTCTT | TCCTCATGTTAGTT | TCTACTGTTAATAT |
| GTTATTTGTTCGAG | CGAAGTTTGATTTT | GTGTGTGATTTTGC | TTGTGCGATTTATG |
| AGTAGTTTTCCTTG | TTCTTTAGATGGGT | TTTTTGGTGACCAT | TTTCTATCGTTAAA |
| TCATTTCTGTTCCA | TAGACCTATTTCTT | CTTGCAGTCTTTAT | TTTGTCCTCGGTTC |
| GTATGCATTATTTC | ATTATTTACGTCGT | TATACCTTTTTGAA | TTCTCGTCTAATAT |
| TGTTAGTGGTCTCT | TAGTATTCGTTCC | GGTTTTATCTCGTC | ATTCCTTCCTTGAT |
| ATGTTGATCCTTAT | GTCACTTCTTAAT | TTTCCGTATTACTC | CCGCTAAGTTTTTT |
| TCTTTCTCTAATGC | TAGCCTGTATGTTT | ATTTCCTCGTTCGT | CTGATTTATGTTGG |
| TTGGTATTCCTATC | CTTTACTTAGATCT | TTTAGGTATTCTCC | TTTCATAGATGTAT |
| CTTGTGATTCTGTA | TTTAGAGTGTTTAG | TTAGCTCCTTCCTT | TTTCTTGGGACTTC |
| TTATTACTCGGATT | CTTGCCTTTTATGC | AACGTTTCAATTT | CGTGTGTTTGACTT |
| ATTTGTGGGATTGT | TATTGTTATGTGAA | GCCTATTTAGCTTT | GTCCCTTCTTTTCC |
| TACTTGATGTCCTT | GTCCTTAATTCCTT | CATTTGCTGCTTTC | AGTTATACTTTGGT |
| GTAGGCTCATTTTT | TTTTGGTCATCTAA | TCATCTTTCGAATT | GTGGTAGTTTCTGT |
| CTTTCATTTAGTAG | TGTTTGATCGCATT | TATGTCTTCATACT | TGGGCTTTAGTTAT |
| GGATTCTTTTAAGT | TACTTTAGCGATTT | CTTATCTAGTTCAT | ACCTTGCTTGTTGT |
| ATTTCTTGACTACT | ATAGATTTCTCAT | TAAGTTCTTTGATC | GTGTAAACTTTCTT |
| TCATGGTATTTGCT | TTATCTTGTATGCC | GTTGTTGGTGCTA | TTCTGACTGTTGTC |
| CATTTATGTTCCGT | TTCGTGTAGTGTGT | CGTATCATACTTTT | CTGTTGTCTTGAGT |
| TTCGTGTTAATTGC | TCTTCGCTTCGTAT | TTTGCGTTCCTCGT | TTTGCCATACTGTT |
| ATCTAGGTTTGTGT | GCTCCTTGTTACTT | TTGCTGAATTCTAT | TTCCCCATGTTTGT |
| GTATGATTCTCTTA | ACTCTTTCAGATT | ATGTTTAACGTTC | TTATCATCTATCTA |
| TCCTGTTTCTTAGA | GTGATCTATGATTT | GCTCTACTATTATT | TAGTTTCTTGCGTC |
| TTCATGTTTCACTC | TAACTGCTATCTTT | ATACTTTTGGTCA | TTGGGTGTTACTTA |
| CTGGTTATTCCCTT | ACTTTTAGATGCT | CTCTTTTCGCGTG | TGTTCTTTGCATAA |
| ACCCTTCTATTTTG | TATTTGTGTTACCA | GCTATATTTGTAG | CTTTCTCTAAAATT |
| CCGTTTCGCTTTGT | TCTCCGTAATTTGT | GAGTGCTTATTTTC | TGATATAGATTGTT |
| ATGATTCTTTCAGT | TGCCCTTAATTTTC | CATTTGATTTACTC | TTACTCGTGTTATC |
| TTGGTTTGCTGTGA | ACGTATCGTTTTTG | TGTGTCAGATTTTC | AATTTCTACCATT |
| GTCTGGTATATTGT | GTCAGTGTACTTTT | TGTGTTCGTTTGCA | TGTTTGTTACTCGC |
| ATTGCATCATTTCT | TTGCCTTGTGATTA | TCTTATCGAATTTA | TCCGTACTATATTT |
| TTGGATTTTTGGAC | GGGGATTTAATTT | TGATATTTTCGAA | CTACTTTAGTGTCT |
| CCCTTTTTGAACTT | TTTGTTGTCGTGCC | GAACTGTTTGTCTT | TCCTGCTTTATTAA |
| CTCTTAGTGTTTCC | ATATTTTGCCCTTA | TTTTGTAGAATGTC | TTATTCAGGTGTTC |
| TCGTTCCTTTCCGT | TCTTATTGGTCGTA | TGGGATTTTCTTCG | TCAGTCTTTTTGCC |
| TGTTACGGTTTTCG | GCTTAAATTTTGTG | GTATATTGTTGCTG | TTATCCTTTCAACT |
| TTCCTTTTTAGAAC | AGTTGTTGATTATA | TGCTTTCTAATTAC | TGCTTTATCTCTGG |
| TGGTTAGTTTAATC | CATTCTGTATTGTG | TACCATTTATAGTT | CTCCTTCTTTGTAA |
| CTTAGTCTTGTCTC | TTTCATTATGGTAA | GTGGTTCTATGTTG | TCAGTTTCTTGAGT |
| TGTTGTTATCAATG | TGTACTTACTCTGT | CTTTTCTTGTCCGC | CTCACTTCTTGTAT |
| ATTTTAGATCGTG | ATCTTAACTGCTTT | ATAGATGCTTTATT | TTTCATCGTGTTCG |
| TTGTTTATGGTGGA | TGTTATAACTTCTA | TGTTTTACGTTGAG | TCAGAGTGTTTTAT |
| TACATAGAGTTTTT | GTTTATTCGTATGC | TAGTCCTTGTTTGG | TAGTTTTCGTTACC |

FIG. 7 (Cont.)

| | | |
|---|---|---|
| TTTTCCTTCGCGTC | GTGCTTTCCTTTA | TTTTTGGTATTCTG |
| CGGTTTTATTACTG | TCATTTCACTTGTT | TATTTTTCGTGTTT |
| TAATAGTGCTTTA | GATTTTTCTCAGTT | GTTTCGTTATTTTT |
| GTTGATATGTATAT | GTATTGGTTTTGCT | |
| CAAGTTGATTTCTT | TATCCTTTGCTTGT | |
| TTATTGTCTTCACA | CTTTTGCTTGCTTG | |
| AGGTATTTGTGTG | TTTGTTGCTTGATG | |
| CCTCTCCTCTTTAT | TCTTTGGATTTTCC | |
| TTAGGTTGGTCTA | ATTTGTGTTTGCTG | |
| CGGTCTCTTTGTTC | TGTACGGTTTTTA | |
| TGTTATGTAACCTT | CCGTAATTATTTTT | |
| CTTTATTCGAGTCT | TTTTTGCGTAGATT | |
| GGTATACTTTCCTT | GTGTTCGTTGTATT | |
| CAGCTTGTGTTGTT | TCTCATTATCTTTG | |
| TTGCGCTTTCGCTT | TGGTGCTTCCTTTT | |
| TAGTCTATTTGACT | GTTTTTCAATGCTT | |
| GTCGTTGGTTTTG | TTGCTTGATTAATT | |
| GGTTTATTGATTA | TATTTGTCTTGAA | |
| GTTTTATGCTATA | CTTTATTGCTTTAG | |
| TGCTATTTTCGGTT | GTTCCATTTTCATT | |
| TATTGTCTTTCAC | GTTAGTGTTTACT | |
| TTGTCCTGGGTTTT | TTTCTCTGTAATCT | |
| TCTTTTGGCTGTTG | CCTTTTCCTTGTCT | |
| ACTTCGACTTTTT | TTCTTTGAGTGTTA | |
| TGCTTTTCTTACCT | TTACTGTCTTGCTT | |
| ATGATCCTTTTTA | TCCTTATTTTTGGG | |
| TTTCTATTGTGTGC | TTTGTGTAATTCCT | |
| TATTTCCTATACTT | ATGTATTTTCGCT | |
| GTTTGTTATTGAG | AATACTTTTTGGTT | |
| GGATTGTTTCTTC | CCTTTATTCGGTTT | |
| TGTATCCATTTGT | TTCGATCGTTGTT | |
| CCTATTTTCTCGTT | GTTTTACTTTTCGG | |
| ATTCTTACTGTATT | TTTACTCTGTATTC | |
| TTGAGTTTATCTTC | TTTAGTCTGTTAGT | |
| CTTCTTCTCTTCTG | TTGTTTTCATCATG | |
| TTGTGTTCTATAAT | AGTTTTTCCATTTT | |
| GTTTGAAATCTTTT | ATCGTCTTTTCTTT | |
| GTCCTTTGATGTTT | ATTGTGTTCTTATT | |
| TGTATATTGTTGCT | TTCCGTATTTGTTT | |
| TTGTCTCGTTGTGT | TAGTGTTTTTGTTG | |
| TCGTACTATTTTC | CTTTGCTTGTTTTG | |
| CTTTTATTACCTTA | TTTTCTTTCGTTGA | |
| TCAGTCTTGCTTTT | TTGCTTCTATTTGT | |

FIG. 8

| Gene Name | Forward GSP | Reverse GSP |
|---|---|---|
| ABCF1 | CTGGAGAGTCACGCCCACA | GGCTGACAACGATCACAGCA |
| ACAD9 | CTGGGGCTGACAGGCAACCA | GGCCACCCGCTTCAGTACCA |
| ACTB | CCACACAGGGGAGGTGATAGCA | ACCCACTCCCAGGGAGACCA |
| AGK | CTGGGCACAACCACAGGA | TCAATGGTGGACAGCTGCA |
| ALAS1 | GTGAACCGGCGAGCACA | CCACCTGCCCCAGCACCA |
| AMMECR1L | GTGCACTTAAGGACAGCCGA | CATGGACCCCTACCTCCCA |
| B2M | ACGTCATCCAGCAGAGAATGGA | TGGTTCACACGGCAGGCA |
| C10orf76 | AACACAGGCTTCACAGTGGCAA | CCATCAGGTCCAGTACTGCACA |
| CALM2 | TGGGCAGAATCCCACAGA | ATGGCGAAGTTCTGCAGCA |
| CC2D1B | GGATCTGAAGCCCCAGCA | CTGTGACTCTGTAGGGCCA |
| CFAP157 | CGGTACCAGCGGAAGTGGGA | CGTGCGCTTGAGGAAGGCCA |
| CIAO1 | CTCGGATCCACAGCAGCCCA | CTCCCCATCATCACTGCAGGA |
| CNOT10 | CCCCTCAGTGCTACCCCA | TTGAAGCCGCCTGGTGGA |
| CNOT4 | GAACCACACAGCAAACCCCA | TGTGAGGGCCTGAAGGGA |
| COG7 | TAACCAGCAGGCCCACCA | GTGAGACTAAAGGCGGGCA |
| DDX31 | CTGGACAAGAGCCATGACCA | TGTAGGAAGAGGCTGTAGTGGA |
| DDX50 | CATCTGCAGAGTGGCCGA | CACTGTGGGCAAGTTGCAGA |
| DHX16 | TCCGTGTACGCAAGGCCA | AGCCACCTCCAGAAGCCA |
| DNAJC14 | TGCATCCTGCTGAGGAAGGAGA | CACGCTGGCATCCAGCCCA |
| EDC3 | CGGGCACCAGTACTCAGCA | CTTGCAGCCAAAGGGCGA |
| EIF2B4 | ATCTGCAATGTAAGCGGGGAGA | GGATCATCCCCAGCTCCGTGA |
| EIF3B | TCAGTCCAAAGCCTCAAGGA | CCCCTCCTCGCAACTCCA |
| ERCC3 | GAGTGGCTCAAGACCCAGGA | GGGCACCAGACCTCAGCA |
| FCF1 | AGAAAAGAAGGATCCCAGCGCA | GGATGTGGTAAGGTGGGCCCA |
| G6PD | CCATCTGGAACCGGGACA | CTCCATGGCCACCAGACA |
| GAPDH | CTGGGCTACACTGAGCACCA | CCACCCTGTTGCTGTAGCCA |
| GPATCH3 | GATGGCCAACACCCCAGA | ATGAGGGGCTGTCTGAAGCA |
| GUSB | GCAAGACAGTGGGCTGGTGAA | CCCAGTCCCATTCGCCACGA |
| HDAC3 | CCTCAGCATCCGAGGGCA | CGGGCAACATTTCGGACA |
| HMBS | TCTGGAGTCTAGACGGCTCAGA | TACGAGCAGTGATGCCTACCA |
| HPRT1 | ATGACCAGTCAACAGGGGACA | TATACTGCCTGACCAAGGAA |
| HSP90AB1 | CCAGACCCACTCCAACCGCA | AGAGGGGGATCTCATCAGGA |
| LDHA | AAAATACAGCCCGAACTGCAA | CAAGGACCCACCCATGACA |
| MRM2 | GACCCGAGAACCTCACAGAGA | ATGTCTGGGGTCACGCTGAGA |
| MRPS5 | GAAGCAAGGAAGAGCAGGAGA | CAAGACTGATGCCTCCCCA |
| MTMR14 | GAGAGACTCGGCTGCAGGA | CCGATGGCACCGGAAGGA |
| NACA | CACCCACAACTACCCTAGCCA | AAAGGTGCAAGATGAGAGCCCA |
| NDOR1 | CACCCCTCACGGCTGCAGA | GTGTCTCTGGGAAGGCCAGA |
| NOL7 | CTGTTGCTCGGGCAGCCCA | CTGGGCGCTGGCGAAAGTCA |
| NONO | GATGGAAGCTGCACGCCA | GCCATCTGACCCATCCGA |
| NUBP1 | CGGAGCTCATGTGCCAGGA | GGCTAACGTGGCTGGGGA |

FIG. 8 (Cont.)

| Gene Name | Forward GSP | Reverse GSP |
|---|---|---|
| PGK1 | CTGCTTGGACAATGGAGCCA | GAACATCCTTGCCCAGCAGAGA |
| PIAS1 | CAGTATCCCGCACCCCAA | GAAAAACCGAGACGAGTGTAGGA |
| PIK3R4 | TGGGTCACTGGACCCACCAA | CAAAGGGACACAAATGCCAGCA |
| POLR2A | GCATGGAGATCCCCACCA | CTGGCATCTGACGCAGCA |
| PPIA | GCAGAGGGTTAAGGCGCAGA | TTGCAAAACCTCAAAGCCTCCA |
| PPIH | CTGCACCGGAGAATTCAGGA | GCCATGGAAAGCAGGCCTGGA |
| PRPF38A | CACACTGCGCTACAGGAGGA | CGGGATCTGTGCCGCCGA |
| RBM45 | AAGTTCGCCCGCAGCTCACA | CCAGATGATCGGGACTGAGCA |
| RPL13A | CCACAAAACCAAGCGAGGCCA | TTGTAGGCTTCAGACGCACGA |
| RPL30 | GTGGCCGCAAAGAAGACGA | GATTTCCTCAAAGCTGGGCA |
| RPL5 | AGATCTATGAAGGCCAAGTGGA | TGGCAAGGCCTGCATCCA |
| RPL8 | CTCCCACAACCCTGAGACCAA | GATGGTGGAGGGCTTGCCGA |
| RPLP0 | TCACTGTGCCAGCCCAGA | TGCTGGATGACCAGCCCA |
| RPS19 | GGAAGCTGAAAGTCCCCGA | CCCCAGCGCCACCCCGGA |
| SAP130 | ATACCCACTGGCGGCACA | GACGGTAGACGCTACCCCA |
| SDHA | GGGAAGCGTGTTGCAAGAA | TAGATGGTCTGCAGCGCA |
| SF3A3 | CCAAAGCCTTCCAGCGACA | GGCCCACAAGGAGACAGCA |
| SLC4A1AP | TTGCACCTGGGGAATGGGAGA | CTGAGTGAATGGCCTCAGCCA |
| TBP | CCACGCCAGCTTCGGAGA | CGGCGTTTCGGGCACGAA |
| TFRC | GGCACGAGCAGCTGCAGA | TCCACGAGCAGAATACAGCCA |
| TLK2 | CGATGCTTGGCCTACCGA | GCCCCAGAGGTTGATGCA |
| TMUB2 | CCCCCCTGAGATCTGAGGA | TTCAGGGCACCCACGGTA |
| TRIM39 | TAGACTATGAGGCCGGCACA | TCTTCCGTCCAGCCCGGA |
| TTC31 | CCCTCCAGCCACTTCCCCA | GGTCCTGGGGCTTGAGAGGA |
| TUBB | GCTCTCACAGTGCCGGAA | TGGACATCCGACCACGGA |
| TUBB2A | GAGGAGGAGGGCGAGGACGA | CTAACAGAGGCAAAACTGAGCACCA |
| UBC | CATCCCTCCTGACCAGCAGA | GAGACGGAGCACCAGGTGCA |
| USP39 | GGCACATGTGTCTCCCCA | TCCTCATGGACCCCTGGA |
| VPS33B | GACCGACAAGGCTGCAGGAA | CTCGCCGTCCACACGTGGGA |
| YWHAZ | AAAAAACAGCAGATGGCTCGAGA | TCTTGTCATCACCAGCGGCA |
| ZC3H14 | CCTGCAAAGCCTTCCCCA | CAAGCAGGGAAGTAACGGCA |
| ZKSCAN5 | CATCAGCGCGTCCACACA | GAGTCGAAGATGTCCAGCCA |
| ZNF143 | GCAGGCTGTGGGAAGGCA | GTTGTAAAGGACCGACCGCA |
| ZNF346 | CACTACCTGGGGAAGACCCA | TGCATGGCAGAGGCTGCA |
| ZNF384 | CTTCAGCAGCACACCCGA | GTGGGACTGCAGATTGGAGA |
| A2M | CAGTTCCTGAACACGGAAGGAA | AAACCTCACCACCTGATGGACA |
| ABCA7 | GGGGGACACATTGGCCAGCA | GATGGCATCGGATTGAGGGCA |
| ABCA8 | AGGGCTGAGGAAAGGGGA | GGTCGACGGCTCATCCAGA |
| ABCB1 | TCCGAGCACACCTGGGCA | AGGGCACGAGCTATGGCA |
| ABCC1 | CAACGGGACTCAGGAGCACA | AGCTCATGGGTGACCGCA |
| ABCG2 | GCACTGGCCATAGCAGCA | TACTGAAGCCATGACAGCCA |

FIG. 8 (Cont.)

| Gene Name | Forward GSP | Reverse GSP |
|---|---|---|
| ABI3BP | AGATGGACGCACTGGGCA | GGACAGGTTCCTGGCGAA |
| ACAN | GGGAGGTGTTCTTCGCCA | TGACGATGGGGTAGCGGA |
| ACE | TTCCAGGAGCTGCAGCCA | CTGAAGGGAAGGGCACCA |
| ACHE | TGCCCCACGGCTACGAGA | GCGGGCAAAGTTGGCCCA |
| ACKR1 | TGGCAGAAGCCCTGGCAA | ATCCTTCAGGGAGGGGCA |
| ACKR3 | AGGAGTGGCTGATCGGCA | TGTCCAGCAGCACCGCCA |
| ACP2 | AAGGAGGGGATGCTACAGCA | TTGGCCTCAGCACTCATGAGA |
| ACTN1 | TGATCAGCTGGAGGGCGA | TGGCATCCCGGGTCAGGA |
| ACVR1 | AGCCATTGCCCATCGAGA | TTGGTGCCCACACGGGGA |
| ACVR2A | AGTTACACCTAAGCCACCCTA | ACAAGTACAGGAGGGTAGGCCA |
| ACVR2B | ACGGACAGGTAGGCACGAGA | TGCAGCCTTGCAGCGAGA |
| ADAM10 | AATGCAAACTGAAACCTGGGA | GCTGGGCAGAGAGCTGTGA |
| ADAM12 | CCGCCAGATTCCTACCCA | GGTGGAGGGGAGGAAGCA |
| ADAM15 | CAACCAGCTCCCTGACCACA | GCCGTTCAGAGGGACCAGA |
| ADAM17 | CTGCGAGAGGGAACAGCA | TCAGCATCGACATAGGGCA |
| ADAM19 | CCGCCCTTCTGCAACACA | GCCTCAGCTTGGAAGGGA |
| ADAM22 | GATAGTGGAAGCCACCCCA | GCTCAGGAAAGCAGTTGCCA |
| ADAM8 | GAGCAGACTGCACCCCAA | CAGCCCTGCTGAACACACA |
| ADAM9 | ACCCTTGCTGCGAAGGAA | TACCTCCTGGAAGGAACCGA |
| ADAMTS15 | CGGAAAGAGCTTCCGGGA | TGCCTTGGACACAGACGGA |
| ADAMTSL4 | GGGGAACCTCACTGACCGA | GACCCAGGGGGATCCACA |
| ADGRA2 | CCTCTGGCACAGAACCCCA | GGAAGTGCGTGGTCACCA |
| ADGRA3 | CGTGGCAACAGCTCGACA | GCGCTGAAGACACTGCACA |
| ADGRE1 | TCTTCCTCGCCGGTATACACA | AACAGTATCACAGCCTCCACCA |
| ADGRE2 | CCCTCCGGAACACAAGGA | GAGGAGGCAGTACACCAGGA |
| ADGRE3 | CTGGCCGCCTTCACCTGGA | AACGCCATAGCCGACTGGGA |
| ADGRE5 | GGCAGCACCACCTGCCAA | GGAGCCCACGAAGAGGCA |
| ADGRF1 | AAGACATCGTGACGTGCCAA | AAAGCCTCGATGATCAGGCA |
| ADGRF5 | CCATGCAAGCAGGAGAAGAGCA | TACCTTCAGATCCCAGAGGCA |
| ADGRG1 | GGGTGTGAGACCGTCAGGA | TGGTGACAAGGCAGGCCA |
| ADGRG2 | ACATGGATGGGCCTAGAAGCA | CATCCGGTGAACCATTGGGGA |
| ADGRG6 | CTGGATGGGCTAGAAGCAA | TGACACCACTAAGGCAGGCA |
| ADGRL2 | TCTCATGGCCCACAGGGAA | TGAAGATGCAGATAGCCAGGCA |
| ADGRL4 | ATCTAAGCCCAGCCGTGGTA | CAACCCTGCAGTGTGACGA |
| ADIPOQ | CCAGGCCGTGATGGCAGA | CCCGGAAAGCCTCGGGGA |
| ADORA1 | CCAAGTCGCTGGCCCTCA | CTTGTGGCAGGACGGGCA |
| ADRA2A | GGTGCTCCGTGCCACGCA | TCTTGAAGGCGCGGCGGA |
| ADRA2C | CCATCAGCCTGGACCGCTA | GACGGCCGAGATGAGCCA |
| ADRB2 | CCACCCACCAGGAAGCCA | TGAAAGACCCTGGAGTAGACGA |
| AEBP1 | TCCCCATTGCCAACGCCA | TCCAGTTGGAGCGAGCCA |
| AGRN | CAGGGTCTCACTGGAGCGAA | ATGGCACCGTCGAAGCCA |

FIG. 8 (Cont.)

| Gene Name | Forward GSP | Reverse GSP |
|---|---|---|
| AGTR1 | CCCGCCTTCGACGCACA | GGCCCAGCCCTATCGGGA |
| AGTR2 | ATAACCCGTGACCAAGTCCTGA | GGAACCCTAAACACACTGCGGA |
| AHSG | AGCTGGCTCACCCCCAGA | CTCCTGAGGGTGACCCCA |
| AKT3 | ATGCAGCCACCATGAAGACA | GACAACCCCTAGGCCCCA |
| ALB | TTGGTGAACAGGCGACCA | TCACGAGCTCAACAAGTGCA |
| ALCAM | ACACGATGAGGCAGACGAGA | ACACCAGCAACAAGGGCA |
| ALK | CAAAGAAGGAGCCACACGACA | CAGCGAAGAGGGCTCTAGGA |
| ALPL | TGCATGAGGCGGTGGAGA | CTCGTTCACCGCCCACCA |
| ALPP | ACAGCCAAGGTGGGACCA | CACAGACGGGTCCAGGGA |
| AMBP | CTGCCAGGGCAACGGGAA | CTCATCACCATCACCAGGGA |
| AMIGO1 | GCAGGTGCAGGTCGAGGA | AGGACCAGGACCACACTAAGGA |
| AMIGO2 | GACTCCATGCCCCTGCAA | CGTTCATCAGCGGAGGCA |
| ANGPT1 | CAACTGGAGCTGATGGACACA | CCAACCTCCCCCATTGACA |
| ANGPTL1 | CAAGCAAAAGAAGCTGGGCA | TGAATAACAGTCCAACCCCCA |
| ANGPTL2 | TCACCACCCTGGACAGAGA | TCCTCGGAACTCAGCCCA |
| ANGPTL4 | GGGACAAGAACTGCGCCA | CCCGCCAGGTCTTCCAGA |
| ANO5 | AAACCACACTGCACCTTCGGAA | ACATCAGGTATCATCCAGGCCA |
| ANO6 | GAAAGCCCAAGACATTGGAGCA | AGTAGTACACTAGGCGGGGA |
| ANO9 | ATCCAGTACGGCTTCACCACCA | GCACACCGATGGTCTCCAGCA |
| ANP32B | GACTCAGATGCCGAGGTGGA | CTGACTTCATCGTCGTCCTCA |
| ANPEP | GCTACACCCTGAACCCGGA | GGAGAACGAGCCACCACCA |
| ANTXR1 | GGGAGAAAAGGGCTCCACA | TCAGTAGGACCCACAAGGCA |
| APCDD1 | TCAACGGTCAGAGGCCCA | GAGGAGGCACACTGGACCA |
| APLNR | GTTACGCACCACCGGGGA | CCACGGTGGTGGACGAGA |
| APLP1 | CCGAGAAGGCACAGCAGA | TCTGGTCAAGCAGGCCCA |
| APLP2 | CTCGAGGAAGAGCGGGAA | CATCACCAGGCTGATGACGA |
| APOB | CTGACCTGCGCAACGAGA | GAATCTGGGGCAGGCCCA |
| APOD | GCCACCCCAGTTAACCTCACA | GGATCCAGTACGGTGCCGA |
| APOE | AGGAGCAGGCCCAGCAGA | CTTCCACCAGGGGCTCGA |
| APOH | AATGGAGCCGTACGCTATACGA | GGAGGGCAGATGATGGGA |
| AQP1 | CTGGCTACTACCGACCGGA | GTGTGTGATCACCGCGGA |
| AQP2 | CAGCTGTCGTCACTGGCAA | CGAGTGCAGCTCCACCGA |
| AREG | CGGTGTGGGGAAAAGTCCA | AGCAACAGCTGTGAGGATCACA |
| ARSF | GTCGCATCAGTGTCAGGAGGA | TGAGCCTTCCAAACTGACCCA |
| ASIC1 | CATGGTCAAGATCCCCAGCAA | GCCCCGATGAACAGCCCCA |
| ASPN | GGTGCAGCCACACCAGGA | GCAGAGCACAAAGCCAGGA |
| ATM | CCGATGGCAAGGAGAGGA | CACTTCGCTGAGAGAGGGGA |
| ATP1A1 | GGAATGATCCAGGCCCTGGGA | TGATCCAGCGGTCATCCCA |
| ATP1A3 | CGCTCTGAAGAAGGCCGA | CCTGTGACGATGGAGGCA |
| ATP1B1 | CCCCGCCAGGATTAACACA | TTCGGTTCACTGGGCACA |
| ATP1B2 | GAATGTGACCCCCAACGTGGA | TTGATGCGGAGTTTGAAGGCCA |

FIG. 8 (Cont.)

| Gene Name | Forward GSP | Reverse GSP |
|---|---|---|
| ATP1B3 | CAGAGCCTGGCCGAGTGGAA | AAGAGTGCAGCCAGGAACCCA |
| ATP6AP1 | CAGCCCTCTCCCTGGCAGA | CGGGGGAGAAGAAGCTGGCA |
| ATP6V0A2 | GCTTAGCCTGGCTCACGCACA | TCTACCCAGTGGAGGCGTA |
| ATRAID | CTGCCTGAATCAGAAGGGCA | AGCCACGGAAGGTGTTGGCCA |
| ATRN | GAGATTGCACCAGCGGCA | AAGGAGGCCACGTAGGCA |
| AXL | CCCAGCCAGACCCTAAGGA | AGGGGTTGTGGAAGGGCA |
| B3GAT1 | AGATGCGCAGCACCAGGA | ACACCGTCTTCCAGCCGA |
| BACE1 | ATCACCATCCTTCCGCAGCAA | AAGACAACGTAGAAGCCCTCCA |
| BATF | GCCGACAGAGGCAGACACAGAA | CTGTTCAGCACCGACGTGAA |
| BCAM | GGATTACGACGCGGCAGA | GCACGGAGCAGTTCACGA |
| BCAN | GCACACCCGAGGAACAGGA | GGACGCCATCCGACCACA |
| BCHE | TCCTGAGGCTCCAGGGAA | GAGATGTTACCGCCCAAGGA |
| BCL2 | GGGGTGAACTGGGGGAGGA | CTCAGTCATCCACAGGGCGA |
| BCL6 | GTTCAACCGGCCAGCCAA | TAAGCACATGGGCACGGA |
| BDNF | CCAGAAAGTTCGGCCCAA | GCCGGACCCTCATGGACA |
| BGLAP | CCAGGAGGGAGGTGTGTGA | GGGCCGTAGAAGCGCCGA |
| BGN | CGGGCCTACTACAACGGCA | CAGGCGGTCAGTGACGCA |
| BLK | AGGGATGAGCAACCCCGA | CCAGCACCGACTGCAGGA |
| BMP1 | CATTGCCCAAGCCCGCAA | GCCTTCCTCCAGAAGCCA |
| BMP4 | GGGCACCTCATCACACGA | CACCTCAATGGCTAGCCCA |
| BMPR2 | CTGCCACAACCCAATATGCCAA | CAGCCGGGTGTCCTCACCA |
| BSG | CATCCGGGGGCAGCTCTGGA | CTCCAGGGGTGAGCTGGGA |
| BST1 | CGTGGACCACAGCACCCA | CCTGGAAGCCAGCACCAGA |
| BST2 | CTGCAACAAGAGCTGACCGA | GGGAAGCCATTAGGGCCA |
| BTD | TGGCTGGGAGAATGACCA | CCTCTCATACAAGCGCCCA |
| BTLA | CGACCCTCCAAGGACGAA | CAGGCAGCAGAACAGGCA |
| BTN2A1 | CAGCCCAGGAAAACGGCA | GATATGCACTCCAGCCGGA |
| BTN3A1 | TATCGGACTCTAACTGAGCCCA | TGCGATCCATCCACAGCA |
| BTN3A2 | GAGAGGCGGCTCCGGGGA | AAGCAGCAGCAAGATAGGCA |
| BTN3A3 | AGCCCACTGCCCTGACCA | GGTGGGCAGGGAGAAGCA |
| BVES | AGAGTCCAGCCCATTGAGAGA | ACATCGGTAGAGAGTGGCCCA |
| C11orf24 | GGCACCGGAGCAGGTAGAGA | GGGGCTCAGTGGTGACCA |
| C12orf49 | AACGTCCCTAGCACGAAGCA | CGGCTGCCCGGTTGAGGA |
| C1orf159 | GCTGGAACGCGGACGGGA | AATGGCGCACCCGGGCCA |
| C1QTNF2 | ACAACGGCCAGTACCGCA | GTCACCCTGCTTGAGAGCCA |
| C3 | CCATCACCACGTGGGAGA | CAACAGAGTAGGGTAGCCGCA |
| C4A | GCAGCCTGTGCCCAGCTCAA | TCCTCCCAGCGGAGGTGGGA |
| C4BPA | CCTAGGCCGACAAAAGAGGA | CAGGGCAACATAACGCCTCA |
| C4BPB | GAGGACCACACCTGGGCA | CCACTCCCCATCAACGCA |
| C5AR1 | GGCCTCTACTCACGCTCACGA | GGTGACGATGGCTCCAGGA |
| C6orf120 | ACCCCTCCCACCTGGAGA | CGAACGGGTGCTGCTCGA |

FIG. 8 (Cont.)

| Gene Name | Forward GSP | Reverse GSP |
|---|---|---|
| CA12 | TACTGCACACACATGGACGA | GAATGCCAGCCAGGGCCA |
| CACHD1 | ACCATGAGCCCACAGGAGGA | AGTCTGAGGGGGGTATCCA |
| CACNA2D1 | GCAGGACATCGCTCAGCA | AGGGAGGCCGTGAAGTCA |
| CACNA2D2 | GCTAGTGCAGAGACCGCGA | GAGCAGCAGTTGCAGGGA |
| CADM1 | AGCCATCGGGAAGCCCCA | ATGAACAGGTTGGGCCCA |
| CADM2 | CCAGAATGGCCCTGACCA | TTGCCAGATATCGACCAAGCA |
| CADM3 | GGCACCTACGGCTGCACA | GAGCATGATGAGCAGCAGGA |
| CADM4 | TGTGGTGAGGGAGGGAGACA | GCGGATACCAGACCCGGCA |
| CALCR | CTGGCTGAGTGTGGAAACCCA | TTGGTCACAAGCACCCGGA |
| CALCRL | AAGAGCCTAAGTTGCCAAAGGA | ATGCCTTCACAGAGCATCCA |
| CALR | GGCACTTGGATCCACCCAGA | GTGCCAGACTTGACCTGCCA |
| CALU | AGAATGGGTAAAGACAGAGCGA | CATAGTCTGAGGGAAGGATCCA |
| CANX | GACGCAGAGAAACCTGAGGA | AATCACAGGTCGCTGCCA |
| CAPNS1 | AAACAGTTCGACACTGACCGA | CACGGAACATGGCGTCCA |
| CASD1 | TGGAAAGGCTGGATGCAA | ATGCAGCAACCAGAACTCGA |
| CAV3 | ACGGCGTGTGGAAGGTGA | CAGAAGGAGATGCAGGCGA |
| CCDC126 | CAGCAGCCAACACCACCA | CAGTGGATGGAGCAGCACA |
| CCDC80 | GAGGACCCAAGGAGAGCACA | TGAGGGAGGTTGGGGCAA |
| CCL1 | GCTGAGGCACTGCCCGTCAA | AGCAAAAGCAGGGCAGAAGGAA |
| CCL13 | CAGATGCACTCAACGTCCCA | ATGACAGCCTTCTGGGGACA |
| CCL17 | GGACCAATGTGGGCCGGGA | CAAAAACGATGGCATCCCTGGA |
| CCL2 | AGGGCTCGCTCAGCCAGA | CTGCTTGGGGTCAGCACAGA |
| CCL22 | GCGCCAACATGGAAGACA | GGTTAGCAACACCACGCCA |
| CCL7 | GAGACCAAACCAGAAACCTCCA | TGAAAGCAGCTGCTGTGAGCA |
| CCR1 | GGTGATCGCCTACACGCA | CCACGGAGAGGAAGGGGA |
| CCR10 | TCTACTGGCTGCGCGCGA | GCCCAGGAAGGCGTAGAGA |
| CCR2 | TACCAACGAGAGCGGTGAA | TAAGATGAGGACGACCAGCA |
| CCR3 | GCTGCATGAACCCGGTGA | GCCCAGGTGCATGAGCAA |
| CCR4 | TGATCATCAGGACCTTGCAGCA | GCTCCACCAGGGTCTCTAGGA |
| CCR5 | GTTTGCGTCTCTCCCAGGAA | CCATGACAAGCAGCGGCA |
| CCR6 | GCATGGACCGGTACATCGCCA | GATGATGACTGACAGCCCCA |
| CCR7 | GGCCCAGACGGTGGCCAA | TGCGGAACTTGACGCCGA |
| CD101 | TGATGAGCCGTCAGCCGCAA | GCTGGAACTGCCACGTCACA |
| CD109 | GCTCCAAGCCTTCCAACCA | CCCCATCCTCACTGGGAA |
| CD14 | CGCTGCGCAACACAGGAA | GTTCAGGGCGCTGGACCA |
| CD151 | CTGGCGAGACAGTGAGTGGA | CACCACCGTCTTGCAGCA |
| CD160 | GGGAACTACACAGTGACGGGA | GGGCCACAAGGCTGGTGA |
| CD163 | ATGGGAGAAGAGACTGGCCA | GGTCCAGTCCCCTGACCA |
| CD164 | AGCACCCGAACGTGACGA | GGTGACCAGCGGGAGGGA |
| CD177 | CCCCGAATGACCTGCCCCA | TGAGAGACTCCAGGCCCTCA |
| CD180 | TAAGCCACAACAGCCTGACA | AGGGAGGAGACGGGGTGA |

FIG. 8 (Cont.)

| Gene Name | Forward GSP | Reverse GSP |
|---|---|---|
| CD19 | ACCGTGGCAACCTGACCA | CCACAAGGGAACACAGGCA |
| CD1A | GCGGCAAGTGAAGCCCGA | TCCCATCAGCACTGGGCA |
| CD1B | TTGAGATCCAGGGCATAGCA | GGGAAGGCACACATGAAGCA |
| CD1C | GAACAGGAGCAACTGGGCA | TCACTCGACAAGACAGGCCA |
| CD1D | GCACTCAGCCAGGGGACA | GGAACAGCAAGCACGCCA |
| CD1E | GGGAAGTCAGCAGAGGGAGA | GAGGAGGAACAGGAGCAGCA |
| CD2 | CAGCAGGGAACAAAGTCAGCA | GAAAACGAGCAGTGCCACAA |
| CD200 | TGTCTCACCCAAATGGGACCA | TAAAGTCGGTCACAGTCCCCA |
| CD200R1 | GAGGCCAGCCTTCCTGCACA | TCATGAGTGATGGCCACGGTA |
| CD207 | GACCTCAGAGAGTGAGCAGGA | GAATGGCGTGTCATCCACCCA |
| CD209 | CCAGCGGAACTGGCACGA | CAACAGAGGTGAGCCGTCCA |
| CD22 | CTGTGAGAGCGACGCCAA | GAGGGTGCTGAGAGGCGA |
| CD226 | GATCGGGACCCAGCAGGA | GAGAGCAGGAATAGTAGCCAACA |
| CD24 | GGGACATGGGCAGAGCA | GGCCAACCCAGAGTTGGA |
| CD244 | CCAGGAAGTCTGGATCCAGGA | TCTTTGCGGCTCAATCGAGCA |
| CD247 | GAAGTTCAGCAGGAGCGCAGA | CCATCTCAGGGTCCCGGCCA |
| CD27 | ACCCACTGGCCACCCCAA | GGCTCTGCAGGCTCCACA |
| CD274 | GTGGTGCCGACTACAAGCGAA | GGGTAGCCCTCAGCCTGACA |
| CD276 | GCAGATGGCCAACGAGCA | GAGACAGACAGACAGCCCCA |
| CD28 | GGTGAAGCAGTCGCCCA | TACAACACAGACTTCCACAGCA |
| CD300E | CGAAACCTCAGCACCGGGGA | TCACCCAGAAGACAGCACCCA |
| CD300LF | AGCAGAAAGCAGCCGGGA | CCTTCGGCAAGGAAGCCA |
| CD302 | CTGCACATCAAGACAGGTGA | TACCGTGCTAGCAATCACCA |
| CD33 | AGACGCCAGGAGGAGGGA | GCTCACAGGCCCAGGACA |
| CD34 | GACCTCCAGCTGTGCGGA | GTTCTGTTGGCCAAGACCA |
| CD36 | AACCCAGGACGCTGAGGA | GCAGCTGCCACAGCCAGA |
| CD37 | CTTGTCGGCGACCAACGA | TGTGGCTCTCTGCAGGGA |
| CD38 | CACAGGTCCAGCGGGACA | TGAGCATCACATGGACCACA |
| CD3D | TGGACCTGGGAAAACGCA | CTGGATCCAGCTCCACACA |
| CD3E | CCAAGCCTGTGACACGAGGA | GCGTCTCTGATTCAGGCCA |
| CD3G | CCAAGGACCCTCGAGGGA | CTGAAGCTCTCGACTGGCGA |
| CD4 | CTGCTGAGTGACTCGGGACA | GCCGGCACCTGACACAGA |
| CD40 | TGGACAAGCTGTGAGACCA | CAGCACCAAGAGGATGGCA |
| CD40LG | TCAGAGCTGCAAATACCCACA | GCCAAGGACGTGAAGCCA |
| CD44 | TCAGTCACAGACCTGCCCAA | TGGACATAGCGGGTGCCA |
| CD46 | GGAGCGGTAAGCCCCCAA | TGGAGCAGCACGACTCCA |
| CD47 | TGCTGCGGATCAGCTCAGCTA | TAAAGTCAGTGGGGACAGTGGA |
| CD48 | GAAAGAGGACAACAGCACCTACA | ACAGACTCGCCAGGTATCACA |
| CD5 | CAGCAGCATCTGTGAAGGCA | GCGTCCAGCACTCGATAGGA |
| CD52 | GGACAAAACGACACCAGCCA | CAACTGAAGCAGAAGAGGTGGA |
| CD53 | AGCGTGGGACTCCATCCA | TCGCATAGCAACCCTCCA |

FIG. 8 (Cont.)

| Gene Name | Forward GSP | Reverse GSP |
|---|---|---|
| CD55 | CATGCCCTAATCCGGGAGA | ACGGGTCACTCCACTGGACA |
| CD58 | CAGAGGCCGGCCCGACGA | GCAGTGCAGCAGGCAGACCA |
| CD59 | ACAACCCGCTTGAGGGAA | AGAAATGGAGTCACCAGCAGA |
| CD6 | GCCACCCTTGGAGGAAGGA | GGGTGATACTGAGGGCCCA |
| CD63 | TCAACGAGAAGGCGATCCA | GCTGCTGCAGCTACCACCA |
| CD68 | CTTCCCCCACGCAGCACA | ACCAGGGCGAGGAGGCCA |
| CD69 | CAATGCCATCAGACAGCCA | AATGACAGCAAGAGTAGCACCA |
| CD7 | TCTCAGGGTCCCAGGACAA | TCCTCTGTCACCAGGACCA |
| CD70 | GCATGGACCAGAGCTGGACA | AGCAGATTCCCACGGCCA |
| CD72 | GCAGCTCCAGCAGACGAA | CTTCCTGACTCTGCGCCA |
| CD74 | CCCCGGAGAGCAAGTGCA | CCTGGCCAGCGAGGAGCA |
| CD79A | GGCAACGAGTCATACCAGCA | CCGCGCAGAACAGGAGGA |
| CD79B | GGACGAGAATCCCCAGCA | ATGGTGAGGGTGGCGAGA |
| CD80 | AGCTGGCACAAACTCGCA | CGCAGAGCCAGGATCACA |
| CD81 | CTATGACCAGGCCCTACAGCA | AGTCAGTGTGCTGGAGCCACA |
| CD82 | TGCAGGAGAACCTGGGCA | GGAATGGACGTGCCGGCA |
| CD83 | CCCCCAATGAAAGGCCCTA | GTGCAGGGCATCCTGTCA |
| CD84 | TACACGTGTACAGCCCAGA | GAACATAGCCAGCACGCTCA |
| CD86 | GAAGAAGCGGCCTCGCAA | CACGCTGGGCTTCATCAGA |
| CD8A | GCCGAGAGAACGAGGGCTA | CTGGCAGGAAGACCGGCA |
| CD8B | GCTGACCTTCGGGAAGGGAA | TGGCCTGGGTAACCGGCACA |
| CD9 | GAAACGCTGAAAGCCATCCA | TGATGGCATCAGGACAGGA |
| CD93 | CCAGCATCCATCACGCCA | CAGGAGTAGGATGGCCACCA |
| CD96 | ACCAGCACAGCCAGAGCA | GCTGCTACAATCACTGGCCA |
| CD99 | AGAAGGGGAAGAGGCCGA | CTCCAGCCACGGCGACCA |
| CDCP1 | CTCTAACTGCAGCCCCACGA | ATGATGAGCCCGAGGGCA |
| CDH1 | GATGCCCCCAATACCCCA | CCAGCACATCCACGGTGA |
| CDH10 | CAGCACAGGCACACTGACCA | TGCAGAGGAGGATGGCGA |
| CDH11 | TCTGAACGCCGGCCTGAGCA | CAATGACCAGGAGAATGACGATGCA |
| CDH13 | CAGGGAAACCACCCATGACGAA | TGAGGGCAGGCTGAAGCGCA |
| CDH15 | CTTCGGACCAGCCTAGCAGA | TGGGTCTGGATCCGGCCA |
| CDH17 | ACTGTCTACCAGGCACACAGA | GCCCACAGTGGGTATCCCA |
| CDH19 | CACAAGCGCTGAGATCAGGA | AAAAGCGTAGGTCTGGAGGGA |
| CDH2 | CTTGAGCCAGCTGCAGCA | GCTGCAGATCGGACCGGA |
| CDH3 | TGACGGTGATCAGGGCCA | GCAGCACCAGCAGGAGGA |
| CDH4 | GGTTGGAGTGGCAGGAACGA | GAGAAACCTGCTGGGCCAGA |
| CDH5 | GCTCCGAGTCCATAGCCGA | GAGCCGTACAGCTCAGCCA |
| CDH6 | CTCCAACAGCTCGCGACA | GTGGTCACTGACTCCAGCGA |
| CDH8 | GTGGACTGGGAGACAAGCAA | TCATCAGCGTCGGTCGCA |
| CDH9 | GACGCAGACCCAAGTGCA | GGCCCCAGTCACTGAGGTA |
| CDON | CGGTTCGAGTCCCAGGAA | GATGCCCACGGGTGGAGA |

FIG. 8 (Cont.)

| Gene Name | Forward GSP | Reverse GSP |
|---|---|---|
| CDSN | AGCAGCAGCTCCAGTTCCCAA | GCCCCCAGTCAGTGTCAAGGA |
| CEACAM1 | GCAACACCACCCTCAGCA | CAACCAGGGCCACTACTCCA |
| CEACAM6 | CTGGCCTCAATAGGACCACA | GAGCCACCCTGGCCAGCA |
| CEACAM8 | GCCCAGATGCCCCCACCA | GGTGGATTAGAGGCCGCA |
| CELSR1 | CTGTCCAGGAACCGGACACA | TCAGGAGGACGAAGGCCA |
| CELSR2 | TGAGCGGCTACAGCGGAA | TGTGTGGCAGACAGCCCA |
| CELSR3 | GCAGCCTTTCACAGCCAGCCA | AGGGGACGTAGAACAGGGGCA |
| CFH | AGGCGGGTGAGCAAGTGA | GGGCGGATTCACACAGGA |
| CGN | GATCGGGGAGGACTCTAAGCA | AAGTCGGCTCAGTCCTCCAGA |
| CHAT | GCTACAACCCCAGCCAGA | TCTCAGTAGGCGGCAGCA |
| CHGA | AGGAGGAGGACAACCGGGACA | CAAGGCTGTCCTCCCGGGA |
| CHIT1 | CAGCCCTCTGAACCTGAGCA | GAGGATTGGGATAGAGCCCA |
| CHL1 | AAGCCACAGGGAGCCCCA | GACTGAGGGTCAGGCCCA |
| CHRNA3 | ACCCCTGCCAGGACGGGA | ACAAAGCAGAGAGGGACAGCA |
| CHST10 | CGACTATCCCTCCGGGCA | GGGCATACAGGCGTCGGA |
| CLCA2 | CATAAGCACCCCAGCCCA | GGCCAGCTGGAACTCCCA |
| CLDN12 | CCGGTATGACGGGAGCAGTGA | ATTGACCAGACACTTGGCCA |
| CLEC12A | AACCTCTCCACCACACTGCAA | GCTGGCATTCTGAGCAGCACA |
| CLEC14A | GAGAAGCTGGGAGAGACACCA | GAGGAGTCGAAAGCCTGAGGA |
| CLEC2A | CTGCGGGATGGCAGAGCTGA | ACTCCAAGCCAGTCCCCTGA |
| CLEC2D | GCATGCCCAGAAAGCTGGA | TCAACCTGAGCAAGATCAGCA |
| CLEC4A | TCAGATCCAGAAGGTCAGCGA | CAACGCAGCGCTCATTGGGA |
| CLEC4C | CTGCTGCCCAACCCCTTGGA | CACCACCAGATCAGCCCCCA |
| CLEC5A | TCAACACGCCAGAGAAACTGA | TAGGCCAATGGTCGCACA |
| CLEC9A | GGGATAGCCCAGCACCAGACA | CCTGCAACAACTTGACGCCCA |
| CLIP1 | CAGCCAAAGCCAAGGCCA | CCTGGCGTAACGGGAGGA |
| CLIP2 | AAGGAGAAGCGGCGCCTGGA | CTCCGCTCCTTCCGCAGCA |
| CLMP | AGGCAACGAAGCTGGGAAGGA | TTCGGATTAGCAGCCACACCA |
| CLU | TCATACGAGAAGGCGACGA | CAAGGAGGAGGTGTTGAGCA |
| CMA1 | CGGGCTCAGACACTCTGCAA | TCCTGGGATTGCCCACACA |
| CMKLR1 | ACAGCTGCATGAACCCCA | TAGAGCATTGACCAGGCGA |
| CNGB1 | GGCGCATGCTGAGAAGCA | TCCTGTCATAGCGAGGGCA |
| CNNM2 | GGTCACCGATCCCTACAACGA | TTCGCCGGTGATCATGAAGCA |
| CNNM3 | CCTGAGAACACCGACCTGCA | AGGGCTGCCTTCCACCGGGA |
| CNNM4 | CACTCGGCAGCAGTACCAGA | TCTCGTCCACCACAGGCA |
| CNR2 | TACGCTCAGTGACCAGGTCA | CAGGCAGTGATGGGCAGA |
| CNTFR | AGACCACGACCAGCACCA | TGATGGGGACGCTGACCA |
| CNTN1 | CCGCGTGGTAGCAACCAA | CTACATCTGAAGGAGCCACA |
| CNTN3 | GGAGACAGGGCACCTCTACA | CACCATCAGAACGTAGCACCA |
| CNTNAP1 | TGAGCCGGCCAGTGCCA | CGGGCACAGGCCGACCA |
| CNTNAP2 | CGCCTGGAGCTCTACAGCCA | GCTGGTGCAATGGCCCGA |

FIG. 8 (Cont.)

| Gene Name | Forward GSP | Reverse GSP |
|---|---|---|
| COL10A1 | ATGGAGAGGCTGGCCCAA | GCTATGCCAGCTGGGCCA |
| COL11A1 | GCAGGCCAAGATGGACCA | GACCAGGTGGACCTAAGGGA |
| COL12A1 | CAGAAGCCCCTACAGAGCCA | GTCCCCAATGCTCCAGGA |
| COL14A1 | CCAGGCGTTGGAACCCAA | CCAGGCTGGCCAGAAGGA |
| COL1A1 | CTGGCAAAGAAGGCGGCA | CCAGCAGGACCATCAGCA |
| COL1A2 | GAGGTCCTAGTGGCCCACA | GTGACCAGCGATACCAGGCA |
| COL26A1 | GGTCCAGCGCGTGTACCAGA | ACCGTCACCGTGCGGTAGGA |
| COL2A1 | GGACGAAGCAGCTGGCAA | CAGCCATCCTTCAGGGCA |
| COL3A1 | CAGGGCCTCGAGGTAACAGA | ACACCACCACAGCAAGGACCA |
| COL5A1 | CGGCCCTACTGGTGAACCA | GGGATCCCTCGAAGGCCA |
| COL5A2 | CTGGGCAACGTGGAGAGAGA | CAGGGTCTCCACGATCACCA |
| COL5A3 | AGGGGGAAAAGGGCCACA | CCAATGGGACCAGGGGGA |
| COL6A1 | CCAGGTGAATGAGCCCCA | GGTGGAAGACACCGCGGA |
| COL6A2 | GTGGTGCAGTACAGCCACGA | GCCCGTCCGTGATGACCA |
| COL6A3 | ACAGCGCTGAGACCACCA | CAACTGCCACTCTGGCGA |
| COL6A5 | GAAGAAGCAGCTCCTCCAGCA | GCTTGAACACGTTGCGGGTCA |
| COL6A6 | GAATGCCCAGTGCACCCA | AGGCGTCTGAGAAGCGCA |
| COL7A1 | TCGAGGCGAGAAGGGAGA | TGAGAGACGCGGAGCACA |
| COMP | TGATGCCTGCGACGACGA | CAGCGTTCTCCGGACACA |
| CP | CGCCGGAAATGAGGCCGA | GGCCACATGTGGAGCGTA |
| CPA1 | GGACCTACAGCCAGGGCA | TGATGGTCAGAAGCGCCA |
| CPD | CCTGGGCAGCATGAAGGA | CTGCCCACAAGGAAGGGA |
| CPM | GAAGCCGTCAAAAAGCCTGA | CATGGAGGTTTGCAGAGAGGA |
| CPQ | CAGGGCCATCATGGAGGA | CTGGCTCCAGGCACTCCA |
| CPZ | ACAGCTTCACGGGAGGCA | GGTGCACCGTCTCCACGA |
| CR1 | ATGTGACCCCCACCCAGA | AGTTCACAGCGAGGGCA |
| CR2 | CCCTGGGCCAGAAAGAGGA | CATGTGAGCACTGGACAGCA |
| CRB2 | CATGGGACTGGGAAGTCAGCA | CCCACCTCCTACAGGATAAGGA |
| CREG1 | CACCATCTCCACGCTGGA | GCAGGTTGCTCACGGAGA |
| CRELD2 | ATCTGCACAGCCTGTGACGA | GCCGCACACTCGTCCACA |
| CRIM1 | CAGAACCCCTCACGCACCCA | CAGAAGGGCAGGACTCAGAGA |
| CRLF1 | CCGCTACCGAGTGGAGGACA | TGCAGCGCACTTGCACGA |
| CRLF2 | CACCAACGCCTCCCAAACCAA | GTATCTCAAAGAGCCGGGGA |
| CRTAM | GTGCCTAACGTAACCCTGCAA | TCATGGTGGAGCACATGAGTACA |
| CRTAP | GCGAGGGTTCCAGGGAGA | GAGCAGATAGCTGACTGCACA |
| CSF1 | GGAGCACCAGGGATCGGA | CCAGCAAGACCAGGATGACA |
| CSF1R | GAAACCCAGGAGGCTGGAGA | CATCCCAGACCTGCAGCA |
| CSF2 | GAGCCGACCTGCCTACAGA | TTCCGGGGTTGGAGGGCA |
| CSF2RA | GAGCTCCTGGAGTGAAGCCA | GCCGAGGACGATGCCACA |
| CSF2RB | TCCAGAACGCCCACAGCA | CACAGAAGCGGAGGGCCA |
| CSF3R | CACGCCACCCATCACCAA | ACCAGAGTGGGGAGGCCA |

FIG. 8 (Cont.)

| Gene Name | Forward GSP | Reverse GSP |
|---|---|---|
| CSPG4 | AGTACGAGGTCCAGCGGGCA | CGAAGGCCAGCCGCCCTGAA |
| CSPG5 | CTGCGAGTCCATCATCACCGA | GAGCTCAGATGGGGTCCGGA |
| CTLA4 | GCTGAACCTGGCTACCAGGA | GCTGTCAGCCTGCCGAA |
| CTSD | GTGAGGCCATTGTGGACACA | CGCCCTGAATCAGCGGCA |
| CTSG | GCAGGGGAGATCATCGGA | CGCACCAGGAACCCTCCA |
| CTSK | AACCCAACAGGCAAGGCA | GGCTTGCATCAATGGCCA |
| CX3CR1 | CAACTCCATGAACAACCGGA | ATTGCGGAGCACGGGCCA |
| CXADR | CCAAAGAGCCGTACGTCCA | GTGGGAGAGTCGGACTCTGA |
| CXCL13 | GGACCCTCAAGCTGAATGGA | CAGAGCAGGGATAAGGGAAGA |
| CXCL16 | GGACCCATGGGTTCAGGAA | CTGAGTGGACTGCAAGGTGGA |
| CXCL5 | AGCCAGGGCCCATCGCCA | CCTTGGAGCACTGTGGGCCTA |
| CXCR1 | GCTCACCAGTCCCTCCCCAA | CCGACAGGGCCCTGTCTCCA |
| CXCR2 | ATCTACGCCTTCATTGGCCA | GTGCCCTGAAGAAGAGCCA |
| CXCR3 | CAGCTCTGAGGACTGCACCA | AGTGGGGCTCCAGGCAGCCA |
| CXCR4 | GCCAACGTCAGTGAGGCAGA | ACAGGATGACAATACCAGGCA |
| CXCR5 | GAGAACCAAGCAGAAACGCA | GATGTGGTAGGGTGACCAGCA |
| CXCR6 | CAGAGGCCATCGCATACCTGA | GTGAGACCCCAAGGTAAGGGA |
| CYBB | GGACGGCCCAACTGGGA | CACTCCCCGAGGGCCAGA |
| CYP27B1 | CCCCGAAGTCCAGACAGCA | TGACCACCGCCTTCAGCA |
| CYSLTR1 | CTGCCACATGCCATGACA | ATAGACCACACGGAGAGGCA |
| CYTH1 | GCCTGCAAGACCGAGGCTGA | GTAGAAAGGGTCCCTGCTGA |
| DAG1 | GGCTGCTCCCTGAACCAGA | CATGGATCTGCCTCCGGA |
| DBT | GCCTATGTGGGGAAGCCA | TCCATTGCCAGACGGCGA |
| DCBLD1 | GTTCCCTGTCAGACAAGCGA | CTCCCCCAAATCGATCTCCA |
| DCBLD2 | ATGTCAGGGCACCCCACA | GGCCTGGGCTGAGGAGCA |
| DCHS1 | GTCCATGCAGGAGGCACA | CAGGGTCAGGGTCAGCACA |
| DCN | TCTGGCCAACACGCCTCA | GTCCAGGTGGGCAGAAGTCA |
| DCT | AAACTCCAGGTTGGCCCACAA | CAACAGCACAAAAAGACCAACCA |
| DCX | GCCAGCTCTCTACCCCCAA | GTCATCCAAGGACAGAGGCA |
| DDR2 | CGAGATCTGGCCACACGA | CCCAAGACATCCAGCGGA |
| DGCR2 | CACCTGCCATGGAGGGA | TGCCATCTGGGTCCAGACA |
| DKK3 | GATGGAGCCTTGGACCGA | GGACCTCTCTGGGCAGCA |
| DLL1 | GCTGCACGGATCTCGAGA | TGAAGCCGGAGTAGCCCA |
| DLL4 | GAGGTGCGGACATCCATCGA | CAAAGCCATAAGGGCAGTTGCA |
| DMXL2 | TCGGGGGTAGGAAAGGACA | ATCTGCATGACTCCAGCCCCA |
| DNER | CACCAACATGCCACGGCA | AATGCGGCTGATGCGGCCA |
| DNMT3B | CCCAAGCGCCTCAAGACA | AAGGAAGCGATCCCGGCA |
| DNTT | CTCAGGTTGCCTAGCAGGAA | ACGACGCTCGTAGGGCA |
| DOCK9 | AGGGAAGCACCCTGGACA | ATCACAGCGAACCACGGA |
| DPEP1 | CCTGCACCAACAAGGCCA | GGGACCCTTGGAACACCA |
| DPP4 | TTGCAGTGGCTCAGGAGGA | CCAACCCAGCCAGTAGTACTCA |

FIG. 8 (Cont.)

| Gene Name | Forward GSP | Reverse GSP |
|---|---|---|
| DPP7 | CCTGACCTTCGCCAGCAA | CCCCAGAAGCTGGTCAGCA |
| DSC2 | AGGGAGAACATGTACGGGGA | CTCATCAGGATCAACCGCA |
| DSG2 | CTGCAGGGAAGCACAGCA | CGCAATGGCACATCAGCA |
| DSP | GACCAAGACATGGCCACCA | CCAGGAAGCGCTGGCCA |
| DYNC2H1 | GGCGCTAAGACCGGACAGA | GAAGGATCAGCACCCGGA |
| EBI3 | CCTGCTCCAAACTCCACCA | GTGACATTGAGCACGTAGGGA |
| ECE1 | CACACGCTCCTCACCCAA | CTTGAAGGCCTCCACGGA |
| EDNRA | AAGCAGCGTCGAGAAGTGGCAA | AGCAGCAGAGGCATGACTGGA |
| EFEMP1 | TCAGAAGCGAGGGGAGCA | CCCAGGACTGCACTGGCA |
| EFNA1 | TCACAGTCCTCAGGCCCA | CACAGTCCAGGCAAGTGGGA |
| EFNA4 | GCCCATCCCCAGGAGGA | CACAGGGCACAGATGGCA |
| EFNA5 | CATGAGTCAGCCGAGCCA | ATCGCCAGGAGGAACAGTAGGA |
| EFNB1 | CCAGGAGTTCAGCCCCAA | GGCGTCACAGCATTGGGA |
| EFNB2 | CCGCTAAGGACTGCGGACA | CCGGGCTCTGCGGGGCA |
| EFNB3 | CTGGGAAGGAGAACCTGCCA | CTCCGCCAACACATGGCA |
| EGFR | GGGGTGCAGGAGAGGAGA | TTTGCGGCAGACCAGGCA |
| ELFN1 | GCTACTCCTCCAGCCCCGA | TAGTCCAGGATGTCGTGCAGA |
| ELFN2 | CAGGAGCCGCCAGTCCCCAA | GGTTCAAGGCCCTCAGAGGA |
| EMB | AGAAGCACTCAGATGAGGGA | TCACTGGCCCAGAGACTCA |
| EMC1 | CGCCCCGAGATCCCAACAGA | ACAAGTGGACTCCAGACCCGA |
| EMILIN1 | ACGGTCCCCTTCGACAGA | TGAGGCTGAAGACGCCCA |
| EMILIN2 | GCAGAGGTTGCAGAGCCA | CTGCCTGACACAGTTCCACA |
| ENG | CCGGGTCTCAAGACCAGGA | CCAGAGTGCAGCAGTGAGCA |
| ENO1 | CAACCCAAAGAGGATCGCCAA | GGCCAGCTTGCACGCCTGAA |
| ENPP1 | CACCGGCTCCTAATAACGGA | GTGAAGGGGCACTGTACCA |
| ENPP3 | TGAGCCATCCCATGCAGAGGA | TGCAGTACCCTAGGCCTCCCA |
| ENPP4 | TTGAGCCCAGTTGCTGCAA | ATTGTCCAGCCTTCATCGGCAA |
| ENTPD1 | CAAGATCCAGGGCAGCGA | AAGACATAGGTGGAGTGGGAGA |
| EPCAM | GAATGGCTCAAAACTTGGGAGA | GACCCCAGCAGTGTTCACA |
| EPDR1 | TGACCAAGCCACCAAGCA | GACCACTCCTGGACGGTGA |
| EPHA1 | ACTGCTTGCCAACCCCCA | GCCGAGTGGAAGTGCAGGA |
| EPHA2 | CTGTGCAGTGGATGGCGA | GCTCAGGGCACTCCAAGCA |
| EPHA3 | GTGAGCCATGCAGCCCAA | GTGATGCTGACCGCAGCA |
| EPHA4 | TCGGACAGCTGCCAGGAA | TGCCCGAGACAGAGACCAGA |
| EPHA5 | TCGAGCACGTACAGCAGCA | GCTGTAGCCACACCGCCA |
| EPHB1 | CAAAATGGTCCAGTACAGGGACA | CTGATGGCCTGCCAAGGTGA |
| EPHB2 | CATGGGCCAGTTCGACCA | GAAAGGAGTCCAGGGAGCCA |
| EPHB3 | CTGAAGGTGGGCTACACCGA | CCCGCAACATGCCCACCA |
| EPHB4 | GCGGCTAAACGACGGACA | GGATGTTGCGAGCAGCCA |
| ERBB2 | TGGCACAGTCTACAAGGGCA | GGAGCCCACACCAGCCA |
| ERBB3 | ATGAACCGGAGGAGAAGGCA | GTACAGGGTGGAGTGGGCA |

FIG. 8 (Cont.)

| Gene Name | Forward GSP | Reverse GSP |
|---|---|---|
| ESAM | TGGCCCAAGAGCTCAGACACA | AGGGCCTGGCTGGAGAGA |
| EVI2A | ATGCCCACGGACATGGAACACA | CTGTTAGCCCACAGACGGGTA |
| EWSR1 | GGAAACGTCCAGCACCGA | CCACGATCCATGAGGCCA |
| EXTL2 | ACACTCATCAGCACCCCAGA | GAATGAGGCTCCAATCAGCA |
| F11R | ACACGGGAAGACACTGGGACA | CAGCACTGCCCGGTTCCCA |
| F13A1 | TCCACCGTGCAGTGGGAA | GTCCAGCTCGCCATACACA |
| F2 | CGGATGCAGAGATCGGCA | GCTTGCCAATGCGCACCA |
| F2R | GCACCTGGCCACGGCAGA | AGCCCAGATGGCCAGACA |
| F2RL3 | GACGGACACAAACTAAGGGATGCCA | GTGAGGGAGAGCCCGTCCCA |
| F3 | GAGTGTGACCTCACCGACGA | CAGAGGCTCCCCAGCAGA |
| F5 | GCAGGGATGCAAACGCCA | TGGGCTCCCAGTAACCCA |
| FABP4 | TGGGCTTTGCCACCAGGA | CATGTACCAGGACACCCCA |
| FABP7 | CTGGAAGCTGACCAACAGTCA | TTGAATGTGCTGAGAGTCCTGA |
| FAM171A1 | CCCAGCTTCCCTGAACGA | GGACCTGCCATCCAAGGA |
| FAM171A2 | GAGGCAACAGCACCGCAA | AAGAAGTCATCCCGGGAGGA |
| FAM174A | GGAGGGAAGGCCGGGGAA | TCATCCTGACCGTCCTGACCA |
| FAM174B | CCCTCAAGGCAGCCGTGA | CCGACCTGAAGACGCGCA |
| FAP | GTGGCAAGTGGGAGGCCA | CCTGGGCCGTAGCAGACA |
| FAS | TCAGAACTTGGAAGGCCTGCA | CCTTCTTGGCAGGGCACGCA |
| FASLG | GCCTCCACTACCGCTGCCA | CCCAGGCCCAATCCTACCAA |
| FAT1 | GAATTCCACCGAGGCCGA | TCACGACAACGTGGGCCA |
| FAT3 | GGAGATGCACAGCAGCGA | GACAGTCCAGCCCTGAGCA |
| FAT4 | GGCACTCTGGTAGGCACCA | CATTGAGGTCCCGCACCA |
| FBLN2 | GCTACACCATGACGGCCA | GAGGACACTCGAAGCGCA |
| FBN1 | TAACCACCGCTGCCAGCA | GATGTGAGCGCTGAGGCA |
| FBN2 | TGAGCTGTGCCCCAAAGACGA | AAATGCCTGGGCTCTCAAGACA |
| FCAR | CGCATGGCCGTGGCAGGA | CAGCTCGGTTCAGCCACA |
| FCER1A | GGTGGTGATGGAGGGCCA | CTCATAGTCCAGCTGCCACA |
| FCER2 | TGACGACATGGAAGGGCA | CCGAAGGCCAATCCAGGA |
| FCGR1A | CTGCGAGGCAGGAACACA | GGCCAAGCACTTGAAGCTCCA |
| FCGR2A | CTCATCCAAGCCTGTGACCA | TGGGCAGCCTTCACAGGA |
| FCGR2B | CTCATCCAAGCCTGTGACCA | TCAAGGCCACTACAGCAGCA |
| FCGR2C | AGCATCAGCCCCAATGCCCA | CAGCATGGAGAAGGCAGAAACCA |
| FCGR3A | AGCTGGCATGCGGACTGA | TCTCGAGCACCCTGTACCA |
| FCGR3B | CCCGGTGCAGCTAGAAGTCCA | CCCAACAAGCCCCCTGCA |
| FCGRT | GGCCCCAACAGTGACGGA | CGATGACGATTCCCACCA |
| FCRL1 | GAGGACAGGTGATGGAGGGA | TTGGGCGAGACACCGGGA |
| FCRL2 | CTACTCCTGTGAGGCCAACAA | AACAGTCCCCAGAGAACTCCA |
| FCRL3 | CCAGATCTGGAGCATCCAGCA | CTGCTAGCCTCCCCTGCAGA |
| FCRL5 | GCAGTGGCCTCTGACCCCA | TGAGGAAGCCAAGAACAGGGA |
| FCRL6 | CAGGTGGAGAGCAGTGCCCA | TCTCCCCACGGTGAACTCA |

FIG. 8 (Cont.)

| Gene Name | Forward GSP | Reverse GSP |
|---|---|---|
| FEZ1 | AAGCAGAAGGAGCAGCGAGA | TGAAGCGCTTGAGAGGCA |
| FGA | GGGGGCTCCTATGACCCAA | GCGAACAGCCCTGAGGGA |
| FGB | GCTCGTCCAGCCAAAGCA | GTAGGACACAACACCCCCA |
| FGF5 | CCTGGGCTCACGGGGAGA | GAGGAGGAGGCAGAAGAGGA |
| FGFR1 | CTGGACCAGTACTCCCCCA | GCAGCGGCTCATGAGAGA |
| FGFR2 | TCAACGGCAGACACCCCCA | CTCCCAGGGGCTTGCCCA |
| FGFR3 | CGCCAACTGCACACACGA | GCTCGAAAGGCGCCGACA |
| FGFR4 | GACCGGGTGTACACACACCA | ACAGCTCCTCCACCGGGA |
| FGFRL1 | GCCTTGGCGCCAACACCA | CAGGCTAGTGGCCGAGGA |
| FGL2 | TAACTATAATGGCACAGCTGGAGA | TACAGCCCACAGTTCCCAGA |
| FKRP | GACCACCGGCAGGATGTGGA | GGGCCCGAACTTGAGCTCCA |
| FLRT1 | TACAACCGGGGCAGCAGGAA | CTGCTGCCGTTGGAGGGGA |
| FLRT2 | TCCTGACTGGGATGGCAGA | CACGGTGAAGAGAGAGAGCCA |
| FLT1 | TCTGGCACCCCTGTAACCA | CACAACCAAGGTGCTAGCCA |
| FLT3 | TCGCAGAAGCATCGGCAA | TGCACAGCACTTGACCAGGA |
| FLT3LG | GCTCGGGACTCAGTGGGA | CATCTTGGACCCAGCGACA |
| FLT4 | CAACAAGGTGGGCCAGGA | CTTGGCAGCTCAGGAGCA |
| FN1 | GAGGAAATAGCCCTGTCCAGGA | CGGCCAGTGACAGCATACACA |
| FNDC5 | TCCACGTGCAGGCCATCTCCA | AGGACCACGACGATGATCAGCA |
| FOLH1 | ATGCTCCAAGCAGCCACA | TCTCTGCAGCTGCCTGCA |
| FOLR1 | CAGCAACTACAGCCGAGGGA | GCCCCACTCATGGCTGCA |
| FOXA1 | CCTGAAAGGGGACCCCCA | CGGGCAACGTAGAGCCGTA |
| FOXD3 | GTTCAGGGGGCGGCAGCA | GTGGCAGTCGTCCGGCTCA |
| FOXG1 | CTCGCTGGGCAACAACCA | AACTGGTCTGGCCCGCGA |
| FOXJ1 | CTACGCCACCAATCCGCA | GCGTGGCGGAAGTAGCAGA |
| FOXP3 | CATCCTGCCACCTGGAAGAA | CGGAACTCCAGCTCATCCA |
| FPR1 | TGCCACCAAGATCCACAAGCA | GGCCACCACCTGATATGGGGA |
| FPR2 | GCACCGTCTGGCTCAAAGAGA | CGTAAAGCATGGGGTTGAGGCA |
| FRAS1 | AGACACTTCAGTCCCCGGCAA | ATCCCCCCTTCTGGAACCCA |
| FREM2 | TGGACCGCACCAAGAGGCAGA | CGTGGTGCCTCCCACCACA |
| FSTL1 | ATCCAGTGGCTGGAAGCTGA | TCACTGGAGTCCAGGCGA |
| FUT1 | GAAGGGTGTGGTGGGCGACA | CCTCCTGTCCATCGCCAGCA |
| FUT4 | GAACTCGCAGCACCTGGA | GGGAGGAGGCACTTGGGAA |
| FUT5 | ACCCCGACTACATCACCGAGA | TGAAGGAGCGAGGCCGCA |
| FZD4 | TCCCCGCAGTGAAAACCA | ACGAACCCGGTGAGGGCA |
| G6PC | ACCCCCATCCCAAGTCGA | TAGGGGATGACACTGACGGA |
| GABRA2 | GCCAATCAATCGGAAAGGAGA | CACAGTTCTTGCAGGCACAGA |
| GABRB3 | TCGGGAGACCTTGCCCAA | ATACTCCAGAAGGGCCAGGA |
| GAD1 | GCTCTCTGACCACCCCGA | TGACCTGTGCGAACCCCA |
| GAD2 | GTGACGTGGAATCCACACAAGA | TGAAGAGGTAGGAGGCATGCA |
| GALC | TGAGCCCTCCCACATGCA | CGCCCACAATCCAGGTCA |

FIG. 8 (Cont.)

| Gene Name | Forward GSP | Reverse GSP |
|---|---|---|
| GALNT1 | ATGCCACCACCTAAAAGGCA | GCAGTCTCTAATGCTGGGCA |
| GATA1 | CTGGGAGGCACAGGAGCA | CCCAGTAGGGGTCCAGGGA |
| GATA3 | CTCACTGGAGGACTTCCCCA | AGTGGCTGAAGGGCGAGA |
| GBX2 | CGGCGGCGGTAACTTCGACA | ACCGTCTCGGCCGCGGAGAA |
| GCG | GGACTCCAGGCGTGCCCAA | CCTCGGCCTTTCACCAGCCA |
| GDF15 | CCGTCGCAGTCGGACCAA | GCCCAGGTCTTCCAGCGA |
| GDF3 | AGCCATCCCTGTCCCCAA | AGATGGTCAGTGAGAAGGGACA |
| GFAP | TCGGAACTCCAGGAGCA | GCATGTTGCTGGACGCCA |
| GFRA1 | GCACAGTCATGACCCCCA | ACGGTCACATCGGAGCCA |
| GFRA2 | GCTTCACAGAGCTCACGACAA | CAGGACAGACAGCACGGTCAA |
| GHRL | TGAGCCCTGAACACCAGAGA | CTAGAGCTCGGGGCTGCA |
| GLG1 | GCAGGAAGCCAAGGAGCA | GATCTGGCTCCAAGCGGA |
| GLMP | GGAGGTAGCCACATTGGGCCA | GAAGGCTCGGACAATGGGTGA |
| GNLY | CGGAGAAACTGCCCAGCA | AGCGAGGAGCCGGCAGA |
| GNPTG | CGAGTGGGAGATCGCCAA | GCTCGGACACATGGGCCA |
| GP1BA | GTGGGGTGCTCCAAGGGCA | TGGCTGTGGTCAGAGCAGCA |
| GP5 | ACTTAGCCCAGCGGCCTGCA | CATCCGCAGGGGAAGACAGA |
| GP9 | CCAGCTGCAGACCCTCGA | TGGGGCTGGCACAGCGGA |
| GPC1 | CTTCAGGCACGCTGGAGA | GGCCATCCCGTTCCAGCA |
| GPC4 | CAACCACAGCAGCTGGCA | GCTCGGAAGGGAGGACCA |
| GPC5 | CAGGCACTCAATCTGGGCA | CAAGGCTTAGTGAGCGCCA |
| GPI | GGGTGTGAGACACACGCCA | CTGGACCGGGATGAGGAA |
| GPM6B | TAAAACAACCGCTTGTGGCCGA | ATCCACACAGATCTGCTCCA |
| GPNMB | AGGGAGCATTCCCACGGA | CCCCAGGGTGAGGTTCACA |
| GPR107 | CCACCGAGGAGGGCACGA | AATGGAACAGCGAGTTTGAGGA |
| GPR132 | TGCCGGGTACTACTACGCCA | GGGCAGCGCTTAAGCCCA |
| GPR174 | CCACTCCTCAGAACCAGTGA | CATAACAACGGACTGGGCCA |
| GPR176 | ATGAGGAAGAGAGTGAGGCCAA | GTGCTCAGGGGTGGGGCA |
| GPR39 | TGCGGCCAAACCCAAGCACGA | GTCGGTGGTGGAGTGCGCA |
| GPR65 | CTGCAACCGGAAAGTCTACCA | ATGCAGCGAATCAGCAACA |
| GPRC5A | TCACGGGCTGGAAGAGACA | CCCAGCCATTGGCAGCCA |
| GREM1 | GCTGCAACAGTCGCACCA | GGGCTTGCAGAAGGAGCA |
| GRIA2 | ATGAGGAACAAGGCAAGGCTGTCAA | TCACGTAAGGGACAGCATGCA |
| GRID1 | GCTGTGACCTCACCAGCCA | CACCACAACTCCAGGGCA |
| GRIK3 | CAAAGCCCTGTCCACACGCA | CCATGCGCTCCACGGTCAGA |
| GRN | CTGCCGAGACAACCGACA | GCGGAAGCCAGCAGGACA |
| GTF3C1 | AGGCACAGCTCAGGCCAA | CAGACAGGTTCCGCACCA |
| GYPA | AAACGGGACACATATGCAGCCA | ATCAGTCGGCGAATACCGTA |
| GZMA | GAGGTGGAAGAGACTCGTGCA | CCCACGAGGGTCTCCGCA |
| GZMB | GCAGGAAGATCGAAAGTGCGAA | GTTACACACAAGAGGGCCTCCA |
| GZMH | GAGGAGATCATCGGGGGCCA | TCTCACTAGGATGCCGCCA |

FIG. 8 (Cont.)

| Gene Name | Forward GSP | Reverse GSP |
|---|---|---|
| GZMM | TCAGGAAGGTCACCGGCCGA | CACCCCACTGCACCCCTGGA |
| HAND1 | AAGAGAACCAGACGCAGGAAGA | GAACTAAACAGGAAGTGCAGCGACA |
| HAND2 | CCAACGTACCCGCCGACA | AAGGCCTCCGCCTCGCCA |
| HAVCR1 | AACCCACGTCACCTATCGGA | CAATATACGCCACTGTCAGACA |
| HAVCR2 | GGCAACGTGGTGCTCAGGA | CCGGCAGCAGTAGATCCCA |
| HEG1 | TGCAAGCGGAAGAGTCCCGAA | TCCACAGTTGAGACCACCA |
| HEPACAM | CCCCGGAGACCGAGGAGA | GGGCAGAGCGGATGGGCA |
| HEPACAM2 | TCACCATGATGCCACCCAA | CCGAGTGCCCCCTTCCACA |
| HES5 | GGGAGGGTGGGTGCCTCCA | GTCGTGCCCACACGCATCCA |
| HFE | CTGGATTGGAGAGCAGCAGAA | AGTGGTCACTGAAGAGGTCACA |
| HHIP | GAAAACAAGTCAGAGGACCAGCA | GAAGAGACGTTGCGAGCCA |
| HHLA2 | GAAGCCAGGAGGAGCAGACA | GCACTGGGACAGCGCTCA |
| HLA-A | CCCCACCCCCATGTCCACCA | AACAGGAAAGATGATTGGGGAGGGA |
| HLA-B | AGGCTGCGTGCAGCGACA | GCTAACAGGGACGCAGACACA |
| HLA-C | GTGCCTTCTGGACAAGAGCA | CAACGATGCCCATGATGGGGA |
| HLA-DOB | CTGAATGGGCAGGAGGAGA | CACAGAAACAGGGCTCAGCA |
| HLA-DPA1 | CTGGGAGGCCCAAGAGCCAA | TATGATGAGGACGGTGCCCA |
| HLA-DPB1 | GTGGAGCACACCAGCCTGGA | CTCCACAGATGATGAGCCCCA |
| HLA-DQA1 | TATGACTGCAAGGTGGAGCA | GAAGCACCAACTGAACGCA |
| HLA-DQA2 | AAGGTGCATCACCATCTACAGGAGA | GTCCCAGAGAAGAGGTGAGAGAAGA |
| HLA-DQB1 | CCAGCCTCCAGAGCCCCA | TGACGGATGATAAGGCCCA |
| HLA-DQB2 | GCGGAGCATCGAGGACTGGA | CCGCTGCAAGGTCGTGCGCA |
| HLA-DRA | GAGAGAGCCCAACGTCCTCA | GGAGATAGTGGAACTTGCGGA |
| HLA-DRB1 | ACAAGCCCTCTCACAGTGGAA | GATGAACAGCCCGGCCCCA |
| HLA-DRB5 | GTCCACAGGCCTGATTCAGAA | CCCCGACTCCACTCAGCA |
| HLA-E | CGCCAGGGACACCGCACAGA | AGCTCGCAGCCATGCATCCA |
| HLA-F | GACCGAGTGGCCCTGAGGAA | CTGGTGATACCCGCGGAGGA |
| HMCN1 | GGGGGACCAGACTCCCAGA | CACCTCCTCCACAGGAGGCA |
| HNF4A | GCTCGGAGCCACCAAGAGA | GCAGCTCCTGGAAGGGCA |
| HNRNPK | TCTCCCATCAAAGGACGTGCA | ATCCCACTGGGCGTCCGCGA |
| HP | GCTGACCAAGACCAATGCA | GGTACTTAGACATGCCAGCACA |
| HPX | CCAAGCCACGTGGACAGA | AGGTACAAGCCGGGACCA |
| HSD11B1 | CTGAAGCAGAGCAATGGAAGCA | ATGGAGGAGAAGAACCCATCCA |
| HSPG2 | GCAGAAGCGAGTCCCAGGGA | TCACGGTGTGGAAATGGCCCA |
| HTR1D | CAGTGCCCTGGAACGCAA | AGCAGGAGTCCCGGCAGA |
| HTR2B | CACCGGAAAAGGTGGCAA | AAGAAGGGACACCACATAAGCA |
| HYAL2 | CGGGGTACACCACAAGCA | CGCAGCTGGGGTTCACCA |
| IBSP | TGAATACGAGGGGAGTACGA | GCCGGATGCAAAGCCAGA |
| ICAM1 | CAAGAACCAGACCCGGGA | GACACTTGAGCTCGGGCA |
| ICAM2 | CACAAACACTCAGCCCCGAA | GAGCAGGACAGATGTCACGA |
| ICAM3 | GTCCAGCTCACGAGGCAA | CGATAGTCACCACGCCCA |

FIG. 8 (Cont.)

| Gene Name | Forward GSP | Reverse GSP |
|---|---|---|
| ICAM5 | TACCTGCCCAAGTCACCAGA | CGCATTGGTGGCCACACA |
| ICOS | AAGGGGGGCAAATACTCTGCGA | GTAACCAGAACTTCAGCTGGCA |
| ICOSLG | AGCCGCTACCGGAACCGA | TGACGTTGAACAAGCGCA |
| IDO1 | GAAAGGCAACCCCCAGCTA | CTGGAGGAACTGAGCAGCA |
| IFI30 | CATGCACGCCAACGCCCA | AACTGGCAGACAAGGGTAAGGA |
| IFNAR1 | CCGCAGCCGCAGGTGGAA | GAAAAGTCACATTCCCGACAGA |
| IFNAR2 | CCCGGAGTCCGAGGAGGA | TCTCACAGGGCCCACTCA |
| IFNG | CTGACTTGAATGTCCAACGCA | GGGATGCTCTTCGACCTCGA |
| IFNGR1 | AAAATACTCACGCAGAAGGAAGA | TCAGTTGTAACACCCCACACA |
| IGDCC4 | CTACCCGGACCTCCAGCCA | CAGAGGAGGAGACCGGGGA |
| IGF1R | CCAGGAACAACGGGGAGA | CCAGCTGTTGGAGCCGCA |
| IGF2 | CCGTGGCATCGTTGAGGA | GAACTTGCCCACGGGGTA |
| IGF2R | GACGACGGGCAGATGCACAA | GTAGAGCAACAGGGCCAGCA |
| IGFBP3 | CAAGTTCCACCCCCTCCA | CCGCTTGGACTCGGAGGA |
| IGLON5 | GACTGCTGAGCAGCGGCA | CCAGGGATCCTGGGCGCA |
| IGSF1 | GAGGCTCAGAGACAGACGGA | GGAACGGGCAGTTCCACA |
| IGSF3 | GGTTCTCAACCGCACCAGCA | AAGGTGGCGTCACGGCTCAA |
| IGSF8 | GGTGGAGCGACCAGAGGA | GTCGGCATGCTGCACCCA |
| IL10RA | CAGCTGCAGTGACCTGGGAA | CAGGCTAGAGATGAGGGGCA |
| IL10RB | AAAGCTGGGGAATGGAGTGA | GCAAGGCGAAGCAGCCGA |
| IL12RB1 | AGGCCAAGGCCACCAGGA | TGGTTCAGGCCAGGACCA |
| IL12RB2 | CTGCTCCAACTGGCCACA | GGGAGCACCGTCCAGGGA |
| IL13RA1 | CCCGAGGGAGCCAGCTCA | GTGCTACACTGGGACCCCA |
| IL13RA2 | AACAAGGGCATTGAAGCGAA | ATGCATGATCCAAGCCCTCA |
| IL17A | GCTGCATCAACGCTGATGGGA | GCCGGAAGGAGTTGGGGCA |
| IL17D | TCGCCCTGGGCCTACAGA | GACGGTGGGCATGTAGACA |
| IL17RA | GGCCGTCAGAAGCAGGAGA | GGCCTCTTGAAGTCCGGGA |
| IL17RB | GTGGCAAGAGCGAGGGCA | GGGGCAGACACTGAGAGCA |
| IL17RD | CTCCACTGCGCTACCGGGA | GTCTTGGTCCAGGCCCCA |
| IL18R1 | GGCTGATATCCCAGGCCA | TCACTAGGCACACTACTGCCA |
| IL1R1 | CGTTGCAGGAGACGGAGGA | TCAGCCACATTCATCACGA |
| IL1R2 | CCCCGCATCAACCTGACA | TAGTGCAGACGTAGGTGCCA |
| IL1RAP | CGGGACCTTGAGGAGCCAA | GGCCGGAACCACAGCACA |
| IL1RL2 | GGACTTCACGGAGCAGTCACA | TGTGTGCTGCAGCAGCTGGA |
| IL21R | CCGGCCTGGATATGGACA | GTGGCGGAGGAATGACCA |
| IL26 | GCTGAGTGGGGTGAAGGGAA | AGACAGAGTGACTAACAGCAACCCA |
| IL27RA | AGAGGTCCCAAGGCACCA | CAGCTCACAGGGACCCCA |
| IL2RA | CACGGGAAGACAAGGTGGA | TGTTGTGACGAGGCAGGAA |
| IL2RB | GTCCTGAAGTGTAACACCCCA | GCGAGATCTCAGGTGCCA |
| IL2RG | CCGGACTGACTGGGACCACA | ACCACGGCTTCCAATGCA |
| IL3RA | CAACAGGCGTCAACAGTACGA | GAGAACCGCTGGAGAGTCGA |

FIG. 8 (Cont.)

| Gene Name | Forward GSP | Reverse GSP |
|---|---|---|
| IL4R | AGGAGGAGGAGGAGGTAGAGGA | TCCCAGGGCATGTGAGCA |
| IL5RA | AGCAAAGACACACTGGGGAGA | TCAATGGCGTGAAGGGCA |
| IL6R | TCCACCCCCATGCAGGCA | GGAGCGTTCCGAAGGCCA |
| IL6ST | GCGCTGTGGAGACGCGGA | AAACAAGGCTTGCACTAGCCA |
| IL7R | TAATAGCTCAGGGGAGATGGA | ATCGGGGAGACTGGGCCA |
| INHBE | GACCAAGGAGGAGGCGCCAA | GACTTCTCACCCCTCAAGCCA |
| INS | GCAGGTGGGGCAGGTGGA | TCCAGCTGGTAGAGGGAGCA |
| INSR | CGGTCAACGAGTCAGCCA | TGGACACCACTCCCAGGA |
| ISG20 | GGGTCACCCCTCAGCACA | CTTCAGGTCATGACCCACCA |
| ISL1 | CAGCAAAAGCGCAGGAAGAGAGA | CCAGCTACAGGACAGGCCAA |
| ISLR | GACAACGAGGTGCAGCCA | GCCTCAGGGTTCCCAGCA |
| ITFG1 | CCAACTCAGCCAATCCGCACA | TTCTCCAGATGGACGGGGA |
| ITGA1 | CAGGTGGGGATGGTAAGACA | TACGGCCACATCTCGGGA |
| ITGA10 | CAGAACCTGACTGAACCCCCA | CCCAAGGTGGCACCTCACCA |
| ITGA11 | GCTTGTTCCCCATCCACGGGA | TGCCCCAGATGTTACAGGA |
| ITGA2 | AGAGTTGCCCCGAGCACA | GGCTTCAAGGGCAGGGCTA |
| ITGA2B | GATGGACGCAGCCAACGA | CCCAGCTCACACAGCACCA |
| ITGA3 | CAGGCCATCATCCCCACA | GGATGGGGCACTCTAGCCA |
| ITGA4 | CGGAGCCAGCATACTACCGAA | CTGCATTGAGGTCCACAGCA |
| ITGA5 | GGGACTCAACTGCACCACCA | AAGCAGAGCTGCGGCTTGGA |
| ITGA6 | GGCTGCCAAATGCAGGCA | AAGCATCAAGATCCCAGCGA |
| ITGA7 | CATGCAGTCTGAGCGGGA | TGAGGAAGGCAGAGCCCA |
| ITGA8 | CAAAGAGGAGGAGGTTGGACCA | CCCGGGCAGAGAAAGGCCA |
| ITGA9 | GATGGCTGACGTGGCCAA | CGCTTCACATGGGCCACA |
| ITGAE | CTCATGCCCACAGAGGGAGA | CTCAGTGTAGCGGTCCAGGA |
| ITGAL | TGGCAGAGGTGTCCCGAA | ATGGAGGGGCTTCAGGCA |
| ITGAM | CTCGAGTACGTGCCACACCA | CAGCAGGGTGAACACGGA |
| ITGAV | GCAAGGTGAGCGGGACCA | CAAGCACTGAGCAACTCCACA |
| ITGAX | GAGGGACCTGCCTGTCAGCA | TCTGAGGAGCACCGAAGGGA |
| ITGB1 | ACCAAGGTAGAAAGTCGGGACA | CAATTCCAGCAACCACACCA |
| ITGB2 | TGAGCGCTACAACGGCCA | GCATACGTTGCAGCGGCA |
| ITGB3 | GGGGAGCCCTACATGACGA | CGGCAAGGCCAATGAGCA |
| ITGB4 | CGGAGGACCAGAAGGGCAA | GCACACACTGTCCGCA |
| ITGB5 | TGGCCAGATCTGCAGCGA | TCCCAGAGTGGAGCAGCA |
| ITGB6 | ATCCCTCCTGCAGCGGAA | TCCAGCCGCTCCTGCACA |
| ITGB7 | ATGCGAGAGACACCGGGA | AGATAGGGGCCAAGGCCA |
| ITGB8 | TTCAGCAGCAGCCCAGCA | GTTCACAGAAGCGGCCGA |
| ITIH2 | AGAAGCCAGAGGCCAGCA | AGAAAGCTGTAGAGCTGAGGCA |
| ITM2B | GTGGACTGCAAGGACCCAGA | AGCTGGGGCATCTGCAGA |
| ITPRIP | CGCAAGGTGCCTGAGGCCA | GGTAGGCTGGTCTGAGGGGA |
| JAG1 | GGTGCCAAGTGCCAGGAA | GCAAGGTCGAGGGCCACA |

FIG. 8 (Cont.)

| Gene Name | Forward GSP | Reverse GSP |
|---|---|---|
| JAG2 | CTGCGACCAGTACGGCAA | CCGGGGTAGGGGACACA |
| JAM2 | TGACAAGAAGTGATGCGGGGA | ATGATGGAACTGCTGGAGCCA |
| JAM3 | CAGGTGTGAGGAGCAGGAGA | CCAACGTGATCAGGGCCA |
| JAML | GCCCGGAAGAGCCTCGAA | TATCAGAACAGGGAGCAGCA |
| KCNA3 | CGAGCTGGCCGAACGACA | GCAATCCCAGCTCCCGCA |
| KDR | GAGCCCAGTCAGAGACCCA | GGAAACAGGTGAGGTAGGCAGA |
| KEL | AAGAGGCTGTTACGGCACCA | CACCACGTGCACAGCGGA |
| KIAA1324L | TCCCAGTTCCAACAAGCCA | ATGCTCCGTACACAGAGGGCA |
| KIR2DL1 | ACCCCCGACACCTGCACA | GAGCACCAGCGATGAAGGA |
| KIR2DL3 | CAACGGAACATTCCAGGCCGA | AAACAAGCAGTGGGTCACTCGA |
| KIR2DS4 | CTGCCTGCTGGAGAGAAAACACA | GCAGCCTCAGGTAGACTAGGA |
| KIR3DL1 | CCAAGGTTCAGGCAGGAGAGA | GACCTTGCGCACTGCAGGGA |
| KIRREL1 | GGAAAGAGCAGCCAAAATCCCAA | TGGGTAGAAAATGTGACCACAGGGA |
| KIT | GTGGATGGCACCTGAAAGCA | AGGGCTGAGCATCCGGAA |
| KITLG | CAAAACTGAAGGGATCTGCAGGA | GCAAAACATCCATCCCGGGGA |
| KLRB1 | CCCACAGACTCAGGCCCA | TGCCAAGGTGAACCCTGACA |
| KLRC1 | AAACCCAAAGAGGCAGCAACGA | ACTATCGTTACCACAGAGGCCA |
| KLRC2 | GGTTTACTGCCACCTCCAGAGA | TAACACAGTGGCCATCAGGA |
| KLRD1 | CAGCATTTACTCCAGGACCCA | GAGAAGCACAGAGATGCCGA |
| KLRF1 | AAAGAAAAGGAGTTCTGCCCAA | AGGATCAAGGAGATCAAAGTCA |
| KLRG1 | CAGGAAATGAGCCTGCTCCAA | GGCACCGCATGTCTGCACAA |
| KLRK1 | GTCTCGACACAGCTGGGAGA | GCTACAGCGATGAAGCAGCA |
| KNG1 | CCGTGGGGAAGAGGAGCA | CACAGCCGAGGCAGTCGTA |
| KRT1 | CTGGAGAATGTGCCCCGA | CCGCCACCTCCAGAACCA |
| KRT10 | GGAGCCTCGTGACTACAGCAA | CTCCAGGTCAGCCTTGGTCA |
| KRT14 | AGGCCCCCGTGTGGACACA | GAGGGGGTGAGGGTGAAGCA |
| KRT18 | GGCTCGGAAGAACCGAGA | TCCAGGTCGATCTCCAAGGA |
| KRT20 | AACTCCAGTCCCATCTCAGCA | CATCAGTTGGGCCTCCAGAGA |
| KRT5 | GTCCCAGATGCAGACGCA | TTGCGGAGGTCATCGCCA |
| KRT8 | GGCTGGAGTCTGGGATGCAGA | TGGAGCCCAGGCTGTAGCTGA |
| L1CAM | GGAGAGGATGTTCCGGCA | GAGGATGAGCAGGACGAGGA |
| LAG3 | GTGCCCAACGCTCTGGGAGA | AAGCCAAAGGCTCCAGTCACCA |
| LAIR1 | GCCGTCGGACAACAGTCA | TCTGGCGATGGAGGCAGA |
| LAIR2 | CCGCCTGGAGAGGGAGGA | GGAAGTCACTGTGCTCAGACCA |
| LAMA1 | CAGTGACACCTGTGACCCCA | GGCTGTGAGGACAGGCACA |
| LAMA2 | GTGGAGCTCACTGATGGGCA | AGCGTTGGCAGGCCACCA |
| LAMA3 | ACTCGGTGGCAGTCACCA | TGGCAGGTGGGAAGGGGA |
| LAMA4 | CCTGGACCCTGAGGACACA | AGTGGCCAGTTCCAGGCA |
| LAMA5 | ACGCGCAGAGCAACCACA | CAGAGCGAGTCATGGCGA |
| LAMB1 | GCCAGTGCGACAAAGCCA | GCAAGATGGCCCGAAGGA |
| LAMB2 | TCACACAGGGGGTGAGCA | GGCCTTCAGGACAGGGACA |

FIG. 8 (Cont.)

| Gene Name | Forward GSP | Reverse GSP |
|---|---|---|
| LAMB3 | CCGACACTGATGCAGCCA | TGGTCTGGGACAGCACCA |
| LAMC1 | TCACGTGACTGGCCAGGA | GCGCTCACAGTGCTGACCA |
| LAMC2 | CAGAGCTGGAAGAGAGGGCA | TGTAGCAGCCTGGGGGCA |
| LAMP1 | GAGCACGTCCGTGTCACGAA | GTCCAGCAGACACTCCTCCA |
| LAMP2 | TGCAGCTGAACATCACTCAGGA | GAGCAGTGTGAGAACGGCA |
| LAMP3 | GCCTCCAGTTGTCAGCCCA | TGATTGACACCTTAGGCGGA |
| LDLR | CAGCACACAACCACCCGA | AGCACGATGGGGAGGACA |
| LEFTY1 | AGGAGGGAGGCAGGACCA | CTCCTTGGCACGAGCGCA |
| LEPR | CTGTGGACAGAGCAAGCACA | TAAGCACTGAGTGACTGCACGA |
| LGALS3BP | ACCTCCCCACCATCCAGA | CGAAGAGCCCTTCGCAGA |
| LGR5 | ACATGCTCACGGGAGTCTCCA | TCACAGAGAACCCACGCTCCA |
| LIFR | GAAGCTGGAGGGACTGCACA | CTGCCCCTCCTACAGGGTCA |
| LILRA1 | CACCCTCAGCCCATCACA | GCAGAATCCCGAGGACCA |
| LILRA2 | CACCAAGCTCAGCAGAACCA | AGGGGGTCACTGGGGAGA |
| LILRA4 | CCACGGTGACCTCAGGAGAGA | ATCTCAGACGCAACGGGGGA |
| LILRA5 | CTGTGACCCCAGCCACA | GAAGGTGTGAGGCAGTCCCA |
| LILRB1 | GACATCGACGTCAGGGCA | GAGTGTCCATCTCCACCCCA |
| LILRB2 | CCTGAACTCCCAGCCCCA | CCGGCTGCACTGAGAGTGA |
| LILRB3 | CCAGCTGCTGACGTCCAGGAA | TTCACCGGGGCATACGTCA |
| LILRB4 | CTACAGGGTCAGTCCCCCA | CTGACGCCAGTGTTGGAGGA |
| LIPG | CTGGTCTACACCGAGGAGGA | TGCGGGGTTGAGACAGGTA |
| LMAN2 | ACACGCCCGACGAGGAGA | GATGCCCAGGAGAGCGCA |
| LMAN2L | CACAGCCATTGTCCGCAA | TGATGGAGGAGGTGCCGA |
| LNPEP | GAACTCAGCCTACACCCGAA | CATGTGACCTGAAGAGCCTGA |
| LOX | CGGCATGGTGGGCGACGA | GCCACCAGGTCTGGGAGA |
| LOXL4 | ATGGACTGGCCCTACGGA | TCAGCCACCTTGGAGCCA |
| LPAR5 | CGAAAGGTCCGCCGTCACCA | GGGCGGAATCCTGGGGACA |
| LRFN1 | CAGTTCACCACCGCTGGGGA | AACGATGAAGACGAGGACCGA |
| LRP1 | AGGGCTTCCAGCACCAACGGA | CGTCCAGTAGGCCTCCCACA |
| LRP10 | CTCACTGCCCCTAGAGCCA | CATCTTCCAGGGCCAGGA |
| LRP11 | GCAGCCTACTCCACAGGAGGA | TTGCGGTCCAGGCCCAGA |
| LRP12 | TCAAGGACAAGGGCTTAGACAACCA | GCTCACAGGGGCCATCTCGA |
| LRP1B | TGGTCAGGCACACAGTGTGAA | ACGAGAGGCACAATGATGGCA |
| LRP2 | GGGAGTGCACAGAGAGCGA | GCCTGGCAGTATGCACCA |
| LRP4 | GTGCCAACCTCAACGGCA | CCAGGTTCTGCCACAGCA |
| LRP5 | GAGGAAGTCAGCCTGGAGGA | GTGGACTGGGCATGAGCA |
| LRRC15 | GCCTAGGTTAGGGACGGACA | GGGACATGGACGCTTGGAACA |
| LRRC25 | ATGTTTGTGGGCCAGCCAGCA | GCCTGGCCCAGTGACTGCA |
| LRRC32 | ACTCAGCTGCTGCGGCAA | GCACGTGGCTCAGGGACA |
| LRRC4B | CCGAGCTCAAATGCCGCA | GCGTGCCGTCATGCAGGA |
| LRRN1 | AGAATGTCCAAGGGGCAGACA | TCATGGACATCGACTGGGA |

FIG. 8 (Cont.)

| Gene Name | Forward GSP | Reverse GSP |
|---|---|---|
| LRRN4CL | GGTCCGCAGAGCCGAACTGA | GGATGTCGGCCCCCTCGA |
| LSAMP | ATGAGTGCAAAGCTGCCAACGA | ACTCAAAGTCAGGTGCAGGCA |
| LTA | GTATCCAGGGCTGCAGGAA | CTGAGGACTAGGTGGGGGA |
| LTB4R | GCCCCAGGAAACAAAGATTCCCA | CTTGTCAGAACAGAGTTGGACCA |
| LTBP1 | CGGAGCCAGAAGTGGCAA | GAGACAGCTGGGGTTGACCA |
| LTBP3 | GTGAACGAGTGCGAGGCA | GTTCAGGTCCACGCACGA |
| LTBR | AGCCACTGCCCCCAGAGA | GCGGACGCCTCTTGAGCA |
| LTF | GCCTCGATGGCAAACGGA | ATCCGAGACACCACGGCA |
| LTK | GAGTGCCTAAGACCCCCACA | GAGGGGCTTGAGGCCAGA |
| LUM | CTGCCCTGAAAGCTACCCAA | ATCTAGAATGAGCCACTGCAGA |
| LY6K | CTCCCAGCGAACGGACGA | CGCTGCACAACCAGCGGA |
| LY75 | AAAGCAGACAGACGTTGCAGA | TGAAGGAGCGCCTGCACA |
| LY9 | CTGAGGTGCACAAGCCCA | GTGACATATGGAGTGACGGGA |
| LYPD3 | CCACCAGGACCGCAGCAA | CCAACAGAAGGGCTGCCA |
| LYVE1 | AGGCGAACCAGCAGCTGA | ATCAGGACACCCACCCCA |
| M6PR | TGCTGGAGGACTGGACTGCTA | GTTGCCAGCTTCCCGGCACA |
| MAF | TGCCGCTTCAAGAGGGTGCA | CTCTCGCGCACCAGCCTGGA |
| MAFA | CTCAGGGGCCATCAGTGGGA | GGCGCGCCTTCCACTCCGA |
| MAN2B2 | GAAAGGCCATCGAGGGGA | TGCAGCACAGCCTCCAGA |
| MAP2 | ACCCCGACGACTCAGCAA | AGCAGTGACATCCTCAGCCA |
| MAP3K12 | CCCTGGACATCAGGGAGCA | CTTGCTCTCGCCTGAGCA |
| MARCKS | CCAGCGGAGGCGGCAGA | CAAAACCAGTACCTGGCACCA |
| MARCO | CCAGAAGGGAGACCAGGGA | GTAACCCAGCATGCGGCA |
| MBP | CCCTGCCCCAGAAGTCACA | GGTGTGCGAGGCGTCACA |
| MCAM | ACGTCAACGGCACGGCAA | GACCAGCTCCAGGAAGAGGA |
| MCOLN1 | CTCGCTCATCAATGGGACGA | TGAGCGCGATGAAGAGGCTGA |
| MDGA1 | CTGCAGTGGACTCAGAGGGA | CGGGAGGCCATGTCACCA |
| MEGF8 | GCCGCAACTGCTCCACGGAA | GCCTCCGACAGCTGAACCCA |
| MELTF | CTCCACTCCCGAGATCCAGA | GGACTTGGCTGACACGCA |
| MERTK | CAGGTTGAAGCAGCCCGA | GGTTCCGAACGTCAGGCA |
| MET | TGGCCACGGGACAACACA | AAGTGCCACCAGCCATAGGA |
| MFAP3 | AACTGGATGGCAGAAGCAGA | TAGGGTGACAGAGTAGGAGGCA |
| MFAP3L | GATGACCAAGAGGGTGGACA | AGCTCGGTGGACGTGACA |
| MFAP4 | GGTCAGCGCAGAGGAGGA | GTGGCAGCTGCGGAACCA |
| MFAP5 | ATTCGCCAGCCAAAGTAGGA | GCAGCAAGAAACAGCAGCA |
| MFGE8 | GTGACAGGCATCATCACCCA | GTCCCAGTTGCCAGGGAA |
| MFSD4B | TTGAGCAACATTGGCAGCCTGA | TTCTCCCAGGGAAGCACCA |
| MIA3 | CACAGGCTGTCAGCTGCAGA | CAGCACGAGCTTTGAGCCA |
| MICA | CGAGGCCTCAGAGGGCAA | TTCCCATCAGGCAGGACA |
| MICB | GAGCCACAACACCCAGCA | CACCAGCGCCTTCCCAGA |
| MILR1 | CCAGGGACCGTGGAGACACA | TGTGGAAACACACGGCCTGGA |

FIG. 8 (Cont.)

| Gene Name | Forward GSP | Reverse GSP |
|---|---|---|
| MIOX | CGGGATGTATCAGCCCCA | GTGTGCCAGGGGTAGAAGGA |
| MIXL1 | ACTGCCTGCCCGAACCAA | GTGTTCCTCCCATGAGTCCA |
| MME | CATAGGACACGAAATCACCCA | ACCTGCCAGGTCCCAGGA |
| MMGT1 | CCAAATACTGTGCAGCCGCAGAA | TCAAGCCACTGAGAAGCCACA |
| MMP13 | CTGAGAGGCTCCGAGAAATGCA | ACCCACATCAGGAACCCCGCA |
| MMRN1 | ATGTCCCAGGTGGGAAAGGA | CGGCCCACTGTATCCAGGA |
| MOXD1 | CACGAGTGCTATCACCCCAA | CCAGCCTCAATCACCCCA |
| MPIG6B | ACCTGGACCAGGAACCGA | CTGCATAGATGGTGGAGGCA |
| MPL | CTAGGGTGGAGACCGCCA | GTCTGGAAGTGAGGGCCACA |
| MPPED1 | TGCTCAACACGGTGCAGA | CACAGTGCATACGGACGCA |
| MPZ | GCCAGGAAGGACGCGTCGAA | ATCCTTGCGAGACTCCCCCA |
| MPZL1 | TCCACTACTCCCAAGGGCAA | GTGTCCAGGCTGGACAACGA |
| MPZL2 | CAGGTGAAGAACCCACCTGA | GCCAGAGCCAGGAAGTGGA |
| MR1 | ACCTATCAGGCGTGGGCA | TGACAAGGACAATGGACCCA |
| MRC1 | GACGACTCCCGAACCCAA | TCCACCCAGAGCTCGACA |
| MRC2 | TACCATGGCAGCTGTCCCCA | AGGATAGACAGGACGGCCCCA |
| MRGPRF | TCAACCACGTCATCCTGGCCA | CCCTGAGCGGCTCCCACA |
| MS4A1 | AGAGCCAATGAAAGGCCCTA | CCCCAGAGAGGGTACCACACA |
| MS4A2 | CTCATCCCCACCACTGCA | TACAGAGCAGACAACTGTTCCA |
| MSLN | GGAAGGGGCCAGCTAGACA | CGGGCCTTGGGATAGAGGA |
| MSR1 | GGAAGCCAACCTCATGGACACA | CCATGTCCCTGGACTGAGGAA |
| MST1R | TGAGAGCTGCCAGCACGA | CCAGTGCAGCCACAAGCA |
| MUC1 | GTCCACGACGTGGAGACACA | CGGCACTGACAGACAGCCA |
| MUC16 | CAAATGGCCAGCACAATCCCCA | GCTCCCAGGCTGGTAGCCA |
| MUC4 | CTTGAGCCTCACGACGCA | AGAGCGCGATCACCGAGA |
| MXRA5 | CCACTGTGCGGGAGATAGCA | GCAGAACCACACCCTCGGGA |
| MXRA8 | CCAGGCCCAGACCCCACA | GCGGCCAGGAGGACAGTGA |
| MYH1 | TTACCCGAACCCAGGCCA | CAGGGCCAGTGCTTCACA |
| MYH10 | CAAGAACCGCCTGCAGCA | CGGCATAGCGAGCAGAGA |
| MYH11 | GAAAGCAACGTGCCCTGGCA | CATCTCTGGAGGCACGGGCA |
| MYH6 | GGCAGAGATCGAGCGGAA | TCTGCAGCGAGTCCACCA |
| MYH7 | TGCCACCCTGGAGACCAA | TCCTCCTGCTCCAGCACA |
| MYH9 | GCCCAAGCAGCTGAAGGA | ATCCTTCCACAGCTCCGAGA |
| MYL3 | AGGACACAGGCACCTATGAGGA | GTGGCCAGCACGTGGCGA |
| MYOCD | AAAGCGGAGAAATGCCAGCAGA | AGCCGAGGGCTTGGTGAGGA |
| MYOD1 | CCAGTGCACTCCGGTCCCAA | AAAAGTGGTCCTGAACCGGGAA |
| MYOF | AGATGAGCCTCCTCCTGAGAGA | AGAAGGTCACCCACCGGA |
| NAGPA | GCCCTCTAACTGCAGCCA | ATGCCAGCCAAGGGGACA |
| NANOG | CCACCAGTCCCAAAGGCA | ACACACAGCTGGGTGGAAGA |
| NCAM1 | GGCAGTGAGTCAGAGGCCA | CATCACACACAATCACGGCA |
| NCAM2 | GCTCTCCAGAACCCGCCA | TGGCCCTGCAGACATAAGGA |

FIG. 8 (Cont.)

| Gene Name | Forward GSP | Reverse GSP |
|---|---|---|
| NCLN | GCTGACAAGCGGGACCCAGA | AGAGGAGGCTGAAGTGCTGGA |
| NCR1 | CACCAGCCTTGCACCTGAAGA | CTGGGCAGTGTGATCCCAGA |
| NCR2 | AGACAAGCCCCTGAGTCTCCA | CTCTTGGCTACGAGGAGTCCA |
| NCR3 | GCACATCCGGGACGTGCGA | CTTTCTCCACCACCAGCCGA |
| NCR3LG1 | GCCTTGCGAGACAACCCA | GCTGGAGGAGGTTCCCAGA |
| NCSTN | CCGAGAGCAGTGCCAGGA | AATCGTGCAGTAGAACGCACA |
| NECTIN1 | CAACTGGTACCTGCAGCGGA | CCTCCACACCCTTGGGGA |
| NECTIN2 | CCTGGTCCCATGGAACCA | CCGCCGTGAGATGAGGGA |
| NECTIN3 | CAGATTTGCTAGAGGAAGGCGA | ATCCAACCTGCTCCACACAGA |
| NEFH | GCCTCCTACCAGGAAGCCA | GGGAGTCCTTCTGGAAGCGA |
| NEFL | TCACCAGCGTGGGAAGCA | GGCTGGTGTAGTAGGACGGGA |
| NEGR1 | ACCAACGTGACACAGGAGCA | GTTAAGAGGCAGGCTCGCA |
| NELL1 | GCCACTCACTTGCCCCAA | TGCAGGGAGATCCAGCCA |
| NEO1 | CAATCCGTTCGAAATACCCCCA | TTCAATGGGTGGGAAGGGCGA |
| NEU1 | CTCCAACCCAGCACATCCAGA | CCTCCAGGGTTGCCAGGGA |
| NEUROD1 | ACACGAACCGTCCGCCGA | ATGGGGATCTCGCAGCGA |
| NEUROG2 | CTGGGAAGAGATGATGGTGGCA | TCGGCGTTAAAGAGAAAGGGGAGGA |
| NFASC | CGGGACACCCAGATCAGCA | ACCATCGCAGTGTGGGGA |
| NFATC4 | CTCTGCCTCGGTCTGAGGA | AATCCGGGCCTTGGACCA |
| NGFR | GCTACCAGCCCGAGCACA | ACTGCACAGACTCTCCACGA |
| NID2 | GGGAGCAGAGCCTGAGACGA | TGGCACGGGGATTCACCA |
| NKX2-2 | ACGCCGGCAAGAAGCGAA | GGCGGATGAGGCTGGCCA |
| NLGN1 | AATACCAGACGACCCCCAGA | TGACGGTCAGCCCAGTCA |
| NLGN2 | CACCAATGGGTGGCACCA | TGACCACGGCACTGAGCA |
| NLGN4X | TCGCTGCAGGCACACGACACA | GCAAAGGCTGCATCCCCGTCA |
| NMUR1 | GCACCTGGCCTTCCAGCA | TCTGAGGCGATGGCAGCA |
| NOMO3 | GAGATCCACGGGAAGGCA | GGGGCCAACACTGTAGGCA |
| NOS3 | GTGCTGCGGGATCAGCAA | CTGACGCTCCTGCAAGGA |
| NOTCH1 | CACAGGACCCAACTGCGAGA | CACAGGCACACTCGTAGCCA |
| NOTCH2 | CCCATTGATCGACGGCCA | CCTCCTCGGAGAGAAGCCA |
| NOTCH3 | TGCAACCCGGTGTACGAGA | CTGGCACAATCCAGCCCA |
| NPC1 | CCTCTGACTCCGGAAGGCA | TGGTGCCATGGCCAAGGA |
| NPHS2 | CAAAGACAAGCCAAAGTGCGGA | ATCGAAGCTGAACGGCAGCA |
| NPPA | CCTGGACCGGGGAAGTCA | CGCAGGCTCCGAGGGGCA |
| NPR1 | CTGGACCCAGAGCAAGGACA | TCCACGTGGAAGACCCCA |
| NPR2 | GGTCAACGCCATGCACCA | AGGCCAACAACCCCAGCA |
| NPR3 | CATGGCATGACCAGTGGAGA | GTGACTGTCTGGAGGGACGA |
| NPTN | TGTCAGCGCTCCTAAAGCA | GGTGGGGGTAGCCAACTGA |
| NPTX2 | AGGACGGAGAGAAGCTGGGCA | TGGCATCAAACCTACCCCCA |
| NPY1R | AGTACAGGTCCAGTGAAACCAA | GCTGTGAGGTGGCAGAGCA |
| NRCAM | CTGTCATGGACCCCAGGCGA | TGTTCACTGCCATCACGCGGA |

FIG. 8 (Cont.)

| Gene Name | Forward GSP | Reverse GSP |
|---|---|---|
| NRP1 | GGTGGGAAGCACCGAGAGA | CGCGTGGAGAGAGCTGGA |
| NRP2 | ACCGAAGAGGAGGCCACA | CACAGGGCTCCTCGAGGA |
| NT5E | CGTGCACCGCTACGGCCA | GAGAGGGTCATAACTGGGCA |
| NTM | TAGCCTCACCTGCATAGCAA | GCCACGTCATTGGAGGCA |
| NTN3 | CGACCCGCGACGGGCACA | GCAGGCTCACGAAGACCA |
| NTNG1 | ACTGCCAGAACGGAGGGA | GCCAGAGTCGGAGCCGCA |
| NTRK1 | ACTGAAGGAGGCGTCCGAGA | CCCTCGGTGCAGACGCCGAA |
| NTRK2 | CGAGAGCCCCACATGAGGA | GAATGTCCAGGTAGACCGGAGA |
| NTRK3 | AGACCTGGCCACCAGGAA | TCAGGAGGCATCCAGCGA |
| NTSR1 | TCTTCTACGTCAGCTCCACCA | TCCTCCTGCGCCGCCACA |
| NUP107 | GAGGCAGAGGTGACACGGA | AATGAGCTAGGAGTTCGAGGGA |
| NUP210 | TCCTCCACATCGACCCCA | TCTGAGGGACGCTGACCA |
| NXPH4 | CACCAAGAGGAAGCCGTCCA | TTGCCGGTCACCAGCAGCGA |
| OAS3 | AGCTACAGCAATGCGGGCGA | ACCAGTGCTTCACCAGCCGGA |
| OGN | CACCTTCCTCTACTTGGACCA | CTTCAATGCGGTCCCGGA |
| OLFM1 | CCATCCTCAAGACCCGCA | TGGCGTACACGGCCCACA |
| OLFML2A | CAACCAGCAGGAAGGCCA | GCTCGTTGAGGAACGGCA |
| OLFML2B | GCGGACCTGAGCACACAGA | CGAACAGCAGCCTGGGGA |
| OLFML3 | CCTGGCAGCTGATGAGGA | GACGACATAGAGGGTCCCACA |
| OLIG2 | CATGGATGGCCTCCGCGA | CGCTTCATCTCCTCCAGCGA |
| OLR1 | TGAAGGACCAGCCTGATGAGA | AGGAGGTCAGACACCTGGGA |
| OPCML | GGAACACCAATGCCAGCA | AAGAGGGTCCCTGATAGCCA |
| ORM1 | CGTGGGAGGCCAAGAGCA | GCATAGACAGACAGCCCCCA |
| OSCAR | CAGTACCGCCACTCCGCGCA | CAGCACGTAGGGCGCGGA |
| OSMR | AACCCAGTAGAGGCACCACA | TCTCGGTCGGGGGAGGCA |
| OSTM1 | CTTCGGCAGCAGTCCGCACA | TCCGGGGGCAGCGACAGA |
| OTX2 | TTCCCGGACCAGGGGCCA | TAAAACCCAAGCTTGAAGCTCCA |
| P2RX7 | GGGCCTGCATCACCACCTCA | GGAATCCACATCCAGCGCCA |
| P2RY10 | AAGGGATCAGTGAGAGGCAGA | ACTTGCAAGGCACAGGCA |
| P2RY11 | ACATAGCCCAGGCCACAGCA | GGGGCAGTGTCGGCAGCA |
| P2RY8 | GCTGTTGCGCACGGAGGA | TGTTGAGGCAGCTGAGACA |
| P3H1 | GCTGGGGCAAGAAGGCAA | CGATGGCAGTGCGGCACA |
| PANX1 | GAAGAACTCACTGCAGAGCGA | ATGTCAAGGTCACGCGCA |
| PARM1 | AGACCACCACCACCTTTCCCA | TAGGTAGGCTGCAACTCCA |
| PCDH1 | CCTGCCCCTCAACTACCCA | GCAGCTGGATGGAAGGCA |
| PCDH15 | TCCAGAGGCAGTGACCAGCA | CAAAACCACCAAGATGGCAGGA |
| PCDH17 | CCTCCCCTCAACTCCACCA | GGATCCTGGGCGAGCACA |
| PCDH18 | CCAGCAGCAGCATCCACA | CCGATCCACCTCACTGCA |
| PCDH19 | TGTGACCATCTGCAGCCCCAA | CACGGAAGGCTTGGTGGGCA |
| PCDH20 | CAGCGAGGAGAGAGGCCAA | CCAACACTGTGAGGGCCA |
| PCDH7 | CACATCCCACTCACCCAGGA | ATGCCAGCAACCACGCCA |

FIG. 8 (Cont.)

| Gene Name | Forward GSP | Reverse GSP |
|---|---|---|
| PCDH9 | AGTCCTGACCTGGCCAAGCA | GGGAACTGCACTCTGAGGCA |
| PDCD1 | CCTGAAGGAGGACCCCTCA | GCTCAGGGACACAGGGCA |
| PDCD1LG2 | CCACACCGTGAAAGAGCCA | TAGTCCCAGGCGACCCCA |
| PDE6B | GAGACGACCCGGAAGGAGA | CTCCCAGAACTCAGCAGCCA |
| PDGFRA | TGGGTACCGGATGGCCAA | CAGGCAGCAGATTCTCCACA |
| PDGFRB | TCAGCTACCAGGTGGCCAA | CAGAGCAGGATCCCGAAGGA |
| PEAR1 | CCCCTGATCCATGACCGA | GGATGCCGTACTGGAGGCA |
| PECAM1 | GACTCACCTGGCCCAGGA | TGCCACTGTGCTCCACCA |
| PI16 | TCCTCCAAGTCCCTGCCCAA | TCCAGCCAACACCAGAGGA |
| PIEZO1 | CAAGTACATCCGTGCCCCAA | TCCTGCAGCTCGATGACCCA |
| PIGT | CTGGTGAACCTGCCGACA | GTGGAAGGTTCGGGTGAGGA |
| PILRA | CAGCACAAGGCCGCCTTCCA | TGTGTCCAGCTCAACTCGGCA |
| PKHD1L1 | AAGGTGACTGCCCAGCCA | ACCGAAGGCTGCTGAGGA |
| PLA2G3 | TGCGGAGGCTTCAGCAGA | CCTGGGTTAGCTGCAGGCA |
| PLA2G6 | GGCCAAGGAACTGGGCAA | CCCAGAGGGCGTTGACCA |
| PLA2R1 | GAGCCGGTGCAGTACACACA | GGCTGCTTGCACAAGGACA |
| PLAT | CCATCCAGCCGCTGCACA | GCGGCCATCGTTCAGACA |
| PLAU | GGTGATCAGCGCCACACA | AACGGATCTTCAGCAAGGCA |
| PLAUR | CAGGACCCTGAGCTATCGGA | CGAGGTAACGGCTTCGGGAA |
| PLBD1 | GGCAAGAGGTGGGCAGACA | GGAACATTGTAGGAGGGCCA |
| PLPP1 | AGGCAGACTGCGGCCTCA | CAAACAGCATGCAGTACATGGA |
| PLPP3 | CAAAGTCCAGGAAGCCAGAA | CTATGCAGCAGGCCACCA |
| PLTP | GAGGTCCAGCTGTCCAGCA | TGGGATCAGAGCCAGCGA |
| PLVAP | ATCAGAAACTCAGCCCTGGACA | CTCCAGGCTAGCTGGGTCGA |
| PLXDC1 | CAGAATCTCGGCGAAGGAGCA | ATGCTGCAGGCAGGTCGGCA |
| PLXNA1 | TGACGGTCACAGGCACCA | CACAGGGTTGGCCACAGA |
| PLXNA2 | GCCCCGATGATCACCCCAGA | TGTACTTGATGGCCAGGGGGA |
| PLXNA3 | AGGCTCAACTCACTGGCCCA | CTCTCGTAGCGGCTGAGGGA |
| PLXNA4 | GGAGGGACCCAAGTGACCA | TGTCCACCTGCACCGACA |
| PLXNB1 | CCAAACTGCCATGCCCCA | CAGTCAGTGGCTCCACCGA |
| PLXNB2 | CCCACGATGCCAACGAGA | CAGGGCCTCATACACGCA |
| PLXNB3 | TGAAAGCCACCGAGGAGCCA | GGTACTTGACGGCGATGGGGA |
| PLXNC1 | GCGAGCTCCGGAAAGAGA | GAAGCCACCTGACTCAGGGA |
| PLXND1 | GGGAATCTCCGACCCCGACA | GTCGATGAAGGCCTGCGCGA |
| PMCH | TCTGCCACTGAATCTGGCTA | CTTGCCAACAAGGTCGGTA |
| PMEL | CATGGGTACCACACTGGCAGA | GGACCTTCAGGCTCAGGGA |
| PMEPA1 | GCAACACGAAGCTTCCAGAACCA | CACAACAGCCATGGAATCAGGCA |
| PODXL | GCCGAGCAGTCAAAGCCA | GTACACATCCTTGGCAGGGA |
| PODXL2 | GCATATGCCTCCCAGAGAGGA | GGGATCCATTCACAGGGAGCA |
| POMC | AGGCCGACCTGGAGCACA | GCGTCTGGCTCTTCTCGGA |
| PON1 | GTGAACCATCCAGATGCCAA | TAAAAGTGCTCAGGTCCCACA |

FIG. 8 (Cont.)

| Gene Name | Forward GSP | Reverse GSP |
|---|---|---|
| POSTN | CAGCAAACCACCTTCACGGA | TTAAGGAGGCGCTGATCCA |
| POU3F4 | TGCACAGGGCCGCAAGCGCA | AGGAGATCTCCTGCGCGGCA |
| POU4F2 | CGCGCTGGCCAACCTCAAGA | CTCGAGCCATGCCTGCAGGA |
| POU5F1 | AGGAGCTAGGGAAAGAAAACCTGGA | CCCAAACTCCCCTGCCCCCA |
| PPY | CAATGCCACACCAGAGCAGA | CCCACTCCGAGAAGGCCA |
| PRELP | CCTGGAGAACGTGCCACA | TCATGAGGTCCAGCGGGA |
| PRF1 | ATCTCCAACTACGGCACCCA | GGCCTTGGCTTCGGCAGA |
| PRG2 | GGAGGTGCTACAGGGGCAA | AGCGACCCGAGCCTGTGA |
| PRNP | CAGTCAGTGGAACAAGCCGA | CCCAGCATGTAGCCGCCA |
| PROCR | CTCGGTATGAACTGCGGGAA | GATGCCTACAGCCACACCA |
| PROM1 | GACCAAAGAGGCGTTGGAGA | ATGGATGCACCAAGCACAGA |
| PROM2 | GAGGAGGTGACTCAGCGCA | TGCACCATGCCAGGCAGA |
| PROX1 | GCCGAAGCGAGAAGGCAA | GAGGTGGGAAGACCTGAGGA |
| PRSS23 | GTGAGCCCTCCTGCTAAGCA | ACATCCTCACATAGACCCCAGA |
| PRSS35 | GGAATCAGCCCAACGATCAAGA | GGATTCGTCGGACACACTGCA |
| PTAFR | CCAACACAGTGCCCGACA | CCGTGCACACCATCCACA |
| PTCRA | CACAGGCCTGGTGCTCAAGA | TGTGACGCAGGGGAGGTAGA |
| PTGDR | CAGCAAAAGCCCACCCAGGA | CGTCTCCACGGACAGCAGAA |
| PTGDR2 | GCCACAGCAACACCAGCA | TGCGGCAGCCCACCACGA |
| PTGER2 | GAGGAGACGGACCACCTCA | CAGGAGGCCTAAGGATGGCA |
| PTGER3 | GGGCCAGTACACCGTCCA | GGTGGCCAGGTTGCAGGA |
| PTGFRN | CTGGCAGAAGGAGGCAGAGA | GACAGGACAGGAGCCCGA |
| PTGIR | GCGCACCGGAGAGGACGA | GCGTAGAAGCGGAAGGCA |
| PTK7 | CCCCTCAGCACCAAGCAGA | TGAGGCCCAGGGCAGACA |
| PTPRA | AGTCAGGGAACCACCCCA | CTGCACCACCTTGTAGCAGA |
| PTPRB | AAGTCACAGCGGAGAGCAGA | CCACGTGATGGCCAAGGA |
| PTPRC | CACCAGCTGGCCAGACCA | GTGCGCCCAACACCAGCA |
| PTPRD | GGGAGCATGGAGAGGAGCA | ACCCAGGCCTTGAGGGGA |
| PTPRF | AGACCCTGCCACGAGCAA | GTAACGTGTGCCTGCCGA |
| PTPRG | GATCCCAAGAGGCCCGAA | GAGAAGGATGAGGCACACGA |
| PTPRJ | CAGCGAATGGCACAGAAGGA | ATGACAGCGCGAGGCTCA |
| PTPRK | CAAGAGAGAAGCCGGAGCCA | CCCACAGTGAACGGGGCA |
| PTPRM | CGATGGGGAGAGCAGCAA | GTGGACACAACTGGGCAGGA |
| PTPRQ | GGCCAGAGGACAACAAGCCA | AGGAACCCCATGCTCTGGCCA |
| PTPRS | CAGTTCACAGACTGGCCGGA | CCACGCCTTCATACCGCA |
| PTPRZ1 | GGAGGAGTGACGGCAGGAA | TCAGGCAATGCTGCACCA |
| PTTG1IP | GGCCGACGCCGTACTGGA | AACTCCCCAGCGTGCAGA |
| PVR | AGCAACCCAGAGCCCACA | TGGCGAGCTCCTAGGGCA |
| PXDN | CTGTGACGCCTCAGGACAGA | CAGTCAGGTGGGCCACGA |
| QSOX1 | CGCTAGCCACTTCGAGCA | ACGTCCCACACGGGCACA |
| QSOX2 | CCAGGGGTGAGGAAGAGGAGA | GGCTGGAGAAGTCAACCCCGA |

FIG. 8 (Cont.)

| Gene Name | Forward GSP | Reverse GSP |
|---|---|---|
| RAB5C | TCCAGGAAGCACAAGCCTA | GGTTTCGGCCTGGAGCACCA |
| RAET1G | CCACCCTCAGTCCCTGCA | GCGAGTCACGTGTCCACCAGA |
| RAMP3 | CACCGGCATCCACAGGCA | CCAGGCCAGCCATGGCGA |
| RCVRN | CCCAGCATGTGTTCCGCA | CCGTCCACGTCGTAGAGGGA |
| RECK | TATCAACTCTGACAGCCCGA | GTCCAGAGCAAGTGCAAGGCA |
| RELL1 | AAGTCCAGAGAGAGCAGACCA | GTTGCCGGCACCTCCCCA |
| REPS1 | TCATCCCAGCGGTGGGAA | CTGACCACACTGCATCACCA |
| RET | CTGCTTCCCTGAGGAGGAGA | AGAGGAGTAGCTGACCGGGA |
| RETN | GTGCCAGAGCGTCACCTCCA | GTGGTCTCGGCGCGCACA |
| RHBDF2 | TCACAGGCAACCTCGCCA | AGCCGAAGATGTGGGCGA |
| RIN2 | CTGACAGCAAACCCCCGA | TGACGCAGGGAGGCAGGA |
| RLBP1 | CTTCATCCGCGCACGGAA | AGCATGACCACTCGGCCA |
| RNF13 | TATCGGAATCCCGCTCACA | CCATTAGGCTGCAACTGGACCA |
| RNF130 | AAGATCAGCCCTCGGCGA | AGGGCACTGAGGAGGCCA |
| RNF149 | TACGGGAACATCACCTTGCCCA | ACACCACAGACTGACCGCTGA |
| ROBO1 | GGATACGGATGCGCCAGA | CATGGACCCCGTGACAGA |
| ROR1 | CTGAAGACTGCCCACCCAGA | TGGGCTGGCACTGAGGGA |
| ROR2 | TGACACACAGAACGCCCCAGA | GGCCTCGTCCACCTGCAGA |
| RORC | GGAGCCTGTGTAGCCAGCA | AAGCGGCTTGGACCACGA |
| RPN1 | CAGCCGCAGAAGCCAGGA | GGTGGAGATGTCCCGGGA |
| RPN2 | GAGGAGACTGTGCTGGCAACA | CGAGTTCATCCAGGCGAGCA |
| RRAD | CACGACGGCAAGCAGGCA | AACCGAGAGGTCGTGGCA |
| RTN4R | AGGCCAGGCTGTTCACGCAA | GCTGCAGGTGAGGCTGGGTA |
| RUNX1 | GTCCACAGTCCACGGTACACA | CTCAGGCTGGGCACGACGAA |
| RYK | GCCAGACTCCCTACGTGGACA | CTCTGGATCTAAGGCCCAGCA |
| RYR2 | CTACACGCAGTCAGAAACGAA | GACGGCGACGTTGAAGCCGA |
| S100A8 | CCGTCTACAGGGATGACCTGA | ACCAGAATGAGGAACTCCTGGA |
| S1PR1 | ACTCCGGCACCAACCCCA | AGAGTCTCCGCTCGGGCA |
| S1PR2 | CTGCCTCTCTACGCCAAGCA | CGTGGCTTGAGCGGACCA |
| S1PR3 | GTCCATGGCACTGCTGCGGA | ATGACCGGGTTCATGGCGGA |
| S1PR4 | CGTCGAGGCTCACTCCGGA | TGGACAGGGCTCCCGCA |
| S1PR5 | CTGCGGGACCACCTCGA | GCCAGTCCCAGGAAGGGA |
| SCARA5 | AATGGCTCAGGTCCGCACGA | CCTCCTCCACACCGCGGA |
| SCARB1 | CGGTCACGGGAATCCCCA | TGGCAGATGACAGGGACCA |
| SCARF2 | CGGGACCTCCAGGGGCGA | GCCAAGCCCCGCCGGGA |
| SCN2B | TGCCACCCTCAACGTCCTCA | TCTCAGCATCACCGACACA |
| SCN4B | CGGCGAGATGGCTGGGCA | CCGGAAGTGGAGGTCCTCGA |
| SCNN1D | GGAACCGCCTCAAGACGA | CCGTCACACAGGGTGACCA |
| SDC1 | TGCTGAGGATGGAGCCTCCA | CAGGCTCCACGGCCACTACA |
| SDC2 | ATGTACCTTGACAACAGCTCCA | TCATCAGCTCCCGAGCCA |
| SDK1 | TCAGCTCAAGTGGAAGCCCCA | ATTCTGCCCGTGCAGGACGA |

FIG. 8 (Cont.)

| Gene Name | Forward GSP | Reverse GSP |
|---|---|---|
| SDK2 | GGTACAGCTCTGCCATCGCCA | CTCACGCCCGGCTTCAGGA |
| SECISBP2L | TCCATTTGACACACCCCA | TGTGAGGCCCATTCCAGGTCA |
| SEL1L | AGCTGAAGCCAGCCCAGA | GTTCCCAACAGCAGCGCA |
| SELE | GGGACAACGAGAAGCCCA | TCCTCACAGCTGAAGGCACA |
| SELL | CAAGGAGGACTGCGTGGAGA | CATGACCAGGGCTGGCAAGA |
| SELP | CTGCACAAACAGCATGCCA | CGTAGAAGCCACCGCTCCA |
| SELPLG | TCCCATGGCAGCCAGCAA | CCTCACCCCATCAGGCA |
| SEMA3A | GGCAATTCCAGAGGCGAA | AACCCATGTTCCACCGCA |
| SEMA3C | ACGGACAAATGGTCCCCA | AGTGGCTGAATGCCCCCA |
| SEMA4A | TGGACAGCCAGGACCAGA | CTCTCAATGGGGAGGCCA |
| SEMA4B | GTAGCCAGCTACTGCCCAGA | AGCAGCACGGCCAGCACA |
| SEMA4C | GGCCCTGTCCTGAACCAGA | GCCGAGTTGGAGAAGGCA |
| SEMA4D | GCGTGTTGAAGGCCGAGA | CAGGCACTGGTACACCCCA |
| SEMA4F | GGACACCTCCACCGAGCA | GCTCTGGAGACGGCCACA |
| SEMA4G | GCCTGAGCACAGTGGCAA | AGGATGAGGCAGAGGCCA |
| SEMA5A | GCAACAACCCCGAACCCA | GGGGACCAGCAAGACCACA |
| SEMA6B | GGCTTAGGGGACTGCACAGGA | CACGGAGGCCCACGAACCA |
| SEMA7A | ACAAGGAGAACGTGGAGCAGA | CAGTGCTGAGCCTCGCGGA |
| SERPINA1 | GAGGACTTCCACGTGGACCA | GCAGCACCCAGCTGGACA |
| SERPINA3 | GAGGAAGCCTTCACCAGCAA | CAAGCACAGCCTTATGGACCA |
| SERPINB2 | TCAGCGCACACCTGTACAGA | TCCAGCAGCTCCAAGCCA |
| SERPINE2 | GTCGACAAGTGCCCCCAA | TCGGCAGTGCAATCAGCA |
| SERPINF1 | AAGCTCGCCAGGTCCACA | AACAGCCTTAGGGTCCGACA |
| SERPING1 | CAGCACCAGACAGTGCTGGAA | CGAAGAGGAAGGGCTGCTGCA |
| SERPINI1 | CAAAATGTAGCCGTGGCCAA | GAGGGCCAGATAAGTGGCA |
| SEZ6L2 | AGGTCCCGAGGAACGACA | AGCCTAGCAGCTCGTAGCCA |
| SFTPB | AGAATGGCTGCCGCGAGA | CAACACAGGCCTGGAGCA |
| SFTPC | TTCCAGGCCAAGCCCGCA | TAGAGCGGCACCTCGCCA |
| SFTPD | GCACACAGGCTGGTGGACA | CAGTCCTCTGACCCGCCA |
| SGCB | AGAAGGCTGTTGAGAGAAGGA | AATGCGAATCACGGCCCA |
| SGCD | GAAGCCACCTGCAGGACAGA | CCCATTGGCGCAGACGCA |
| SGCE | ATGTGCTGCCGACGGGAA | AAGCGTTGACAGGGGCCA |
| SGCZ | TGAGAGCCAGTGAAGATGGCA | GCGTCTCCACAGAGTGCCCA |
| SIDT2 | GCAGAGTCGAGGGAGCACA | ACACCAGGAAGGACCCGA |
| SIGLEC1 | CTGGCGTCTACACCTGCCAA | GGCATCCTCCAGCAGGACA |
| SIGLEC10 | CATCCTGCAGCTGCCAGA | GATGATCAGGGCCAGGCA |
| SIGLEC12 | GGAAGGGGATTCAGGGA | CCCCTGTTCACAGGCCCA |
| SIGLEC5 | CTGGAGGGAACAGCAGCCA | GACAGATACAGAGCAGGGCCA |
| SIGLEC6 | CCAGGACCACAGCACCAA | GGGGAAGCCCTGGAACCA |
| SIGLEC7 | AGCCAGACTGACTCTGACCCA | TTCCTCCTGCACTGCCCAA |
| SIGLEC8 | GGGGAGGGACCTGGTGGGA | GGCGGGGGAGGCCTCAGGA |

FIG. 8 (Cont.)

| Gene Name | Forward GSP | Reverse GSP |
|---|---|---|
| SIGLEC9 | GGCCCAACATCCTCATCCCA | GACACGGAGGTCCCTATCCA |
| SIRPA | AGCCCACCCGAAGGAGCA | CCGCCATCAGTAGGGCCA |
| SIRPB1 | GGAGACTCACAGGAGTGGCA | GGGATCAGGGACGTCATAGCA |
| SIRPG | GCATCCGCAGCACAGCCA | CAAGTTGGCAGTCCCACGA |
| SLAMF1 | AGGAGAACGGGACCTGCA | GTGAGGGACAGGAGGTGGGA |
| SLAMF6 | ATGGGAGGCCTTGGGAAACACA | ATCTTCGCAAAGCTTCTGGGCA |
| SLAMF7 | AAGCAGCCAATGAGTCCCA | CAGAGCTTCCTGGCAAGGA |
| SLAMF8 | GGCGACGGGAGACAACCA | CAGCATCAGGAGCAGCGA |
| SLC12A6 | AGAGCGAGACAGAGAGGCACA | GTCCGGACGCATGTTAAGCA |
| SLC12A7 | GACACCGTCCGCGACACCA | GTTGTCGTCCACCTGGGCCA |
| SLC12A9 | GGACCCTGTACAGCCGCA | CCGGAGATTCGCAGCAGA |
| SLC14A1 | GATAATCCATGGACAGGGGCA | CGACTCCAAGATAGGCCGTGA |
| SLC17A6 | CAAATTCAACTGGGACCCGGAA | CTGTTGGCTGCCAGCCGAGA |
| SLC17A7 | AAGCACAAGACTCGGGAGGA | TGTCGTCACTGCCAGCCA |
| SLC1A3 | GACAAGCGCGTCACCAGA | CCGCGATGATGAGCGTGA |
| SLC22A16 | ATGGACAAGGTCGGGAGGAGA | GTCCACAGAGAACGGCGCCA |
| SLC23A2 | GCCAGCTCATTGGGACCA | CGGATCCGGGGATACCAGA |
| SLC26A5 | GGAACCGGTGGGAAGACACA | CAATCACAATGGCCGACAGCA |
| SLC29A1 | CAGAGACCGCAGGAGCCA | TGCCCGGAACAGGAAGGA |
| SLC29A2 | GCTCCACCAGTCCTGGGAA | TCTGGGGCACGTGGCACA |
| SLC29A4 | GGGTGATCTGGGCCGACA | GAAGACCACACGCAGGCA |
| SLC2A1 | CTCCACGAGCATCTTCGAGA | CAGGGTAGCTGCTCCAGCA |
| SLC2A2 | AAATTGGGCCAGGCCCGA | AAGGCCAGGAGCACTCCA |
| SLC2A4 | CCTGGGGACGCTCAACCA | AGAAGGGCAGCAGGACCA |
| SLC32A1 | CGTGGTGGTGAGTGGCAA | AGTGGGCCAGAGTGCACA |
| SLC38A1 | TGACAACGTGCAGTCCGA | AGGTAACCACGGTATGACGACA |
| SLC39A10 | CCAGTGGCACCACAAGCA | GCACCAATTGCGAGCCCA |
| SLC39A14 | GAAGCTGCAGAACGGGA | GCGGACACCTTTCAGCCA |
| SLC39A6 | CAGCGCTACTCTCGGGAGGA | AGCAGCACCAATTGCTAGGCCA |
| SLC3A2 | CTGCTCAGCACCCAGCCA | CGTAGGGAAGCGGAGCA |
| SLC44A1 | TAGGTACGGTGGCAAAAGGA | TCAGCACACATCGTGCACA |
| SLC46A1 | CGGGCCCAGGGTTATGCCAA | TAAGATGTCCTGGGCCCCA |
| SLC4A1 | TCACGTCGCTCAGCGGCA | CGTGGACTTCACCACCCA |
| SLC4A7 | TGAACCTCCAAACCCCAGCAA | GATGACCACAAGCTGACCCCA |
| SLC6A6 | CCTGGAATCGACCACCCA | AGGCGGGTGATGTCAGGA |
| SLC7A5 | CCCTGGCCATCATCGGCA | TCCAGAAGGAGACGGCGA |
| SLC8A1 | CCATCTACCACGCAGCCA | CGATACAGCAGCACCCCCA |
| SLC8B1 | GATCTCCCGAAGCCACACAGA | CAGGTAGAAGAGGAGCAGGCA |
| SLC9A1 | GATGCTGCTCCGGAGGCAGA | GGTCGATGGTGATGACAGGCA |
| SLCO2A1 | CCCCGCATAGCTACCACCA | GGGGTAGACTTCGGCCACA |
| SLCO3A1 | CCCGAAGGTCACCAAGCA | CCAGACAAGCACACGGGA |

FIG. 8 (Cont.)

| Gene Name | Forward GSP | Reverse GSP |
|---|---|---|
| SLCO4A1 | TCGGCTGGGTGATCGACA | CACCTTGTACAGGAGCCCCA |
| SLCO4C1 | TCCGAAGAGAAGCTCCGGTCA | CAATACCTTGCGTGACGGCCA |
| SLIT2 | TGGACCGCTGAGGAGCAA | ACACCTCGTACAGCCGCA |
| SLIT3 | CAGGTGGCCACTGACAAGGA | AGCGTCACCAGCTCCACA |
| SLITRK2 | GCTAGAAAAGCAGGCCACACCA | GACTAGGCCTGCGCTGGGAA |
| SLITRK3 | GGCATCCAAATGCAATGCCACA | CTCATACACATGACCCACGGGA |
| SLITRK4 | TCCGGAGCACCCTTAGCTA | TCACAACAATCCCGTCGCTCA |
| SLITRK6 | CCCCCGGGCATCTCGACA | TTGTTGCAGGAGTGGTGACCA |
| SMAD2 | GAGCAGAATACCGAAGGCAGA | GCAACGCACTGAAGGGGA |
| SMO | GGCCTTCTCTAAGCGGCA | TGCCACAGGGGTGACAGA |
| SMPD3 | GGGTACATCGCCTGCACA | GTTGGCTGCGCTGGACGA |
| SMPDL3B | CTCGAGTACCAGCTGACCGA | CAATGTCCACCTGGCGCA |
| SMTN | CCTCAGAACCGACGCCAGA | ACCTCCACCAGGGGCACA |
| SORCS1 | ACCCTGAACCACCCAAGCAACA | CAAGCACCCCACTGCTCTCAA |
| SORCS2 | GAACCTTACACTGACCGGGGA | TTGAGGCCAATGACAGGAACCA |
| SORL1 | CAGTGGGTCCCAGATGGAGA | CCCTGAGGGCAGTCACACA |
| SORT1 | AGCCGAATGCCGTAGGCA | GATGCCTCCAGAATCCAGGA |
| SOX17 | GAGGTGGACCGCACGGAA | AGCTGGCGTCGGACACCA |
| SOX2 | ACATGAACGGCTCGCCCA | CCTCGGACTTGACCACCGA |
| SOX7 | AACACTCCTGGCCACCCA | TGGCCGTGGCATCAGCCA |
| SPANXC | GGCCAACGAGATGATGCCGGA | ACGTTCCTCCTGTAGCGAACCA |
| SPN | GTCTCCAACGACCTCCACCA | CGCCACAGCAGGAGCAGA |
| SPPL2A | GCACAACCAAGGACTACTGCA | GGCAGCTTCCCCATGGAA |
| SPPL2B | CATCACGCCCTTCCTGACCAA | CAAAATGTCTCCGAAACCCAGGA |
| SRPRA | AGCATGGTGGCCGCACCA | CTGCCGTGTCCACCAGCA |
| SSR1 | CCCATGGGCGGACGACCA | CTAGGAGTTGATGAAGGCCA |
| SSR2 | GCACCTGGACAGGGAGGAA | CGATGGAGGGAAGGGTCA |
| SST | GGACCCCAGACTCCGTCA | GATCTTCAGGTTCCAGGGCA |
| ST3GAL1 | CAACTGGCTGCAAGGGCA | CAAGTCCACCTCATCGCAGA |
| ST3GAL4 | CAAACTGCTGAGCCTGCCAA | CACAGAGGTGGAGGGCCA |
| ST6GAL1 | CCTCCCATCCAAGCGCAA | TCATAGAGCAGCGGGTGGTA |
| STAB1 | GGCCTATGGCATCGACCA | CCTGTGACCCCTCAGGACA |
| STAT4 | GGTACAACGTGTCAACCAACGA | TAAGACCACGACCAACGTACGA |
| STAT6 | GACCGTGGAAAGGGACCA | TGGAGGAATCAGGGGCCA |
| STEAP4 | GAGGCACAAAATACCGTCGA | GAATCACTGAGCCAGGCTGA |
| STIM1 | CTGCCCTCAACATAGACCCCA | GCTGCCGAACACTGCTCTGCA |
| STS | CCCTTGCCTGAGGACAGGA | TCTGAGGGTGCCAGCGCA |
| SUCNR1 | GTGCACCCTCCCCATGCTGA | TAAAACCCAAATGGCCAAGGAGA |
| SUCO | TGGGCAGCGGTGAACAGGAA | CTGCGCTGCCGATAAAGAGCA |
| SUSD1 | CCACGCCTCAGACTGAGGA | CTTTGAGGGCCAGGGGA |
| SUSD2 | GCTGAGCTTCACCGAGCA | CAGGCAGCAGGACGGACA |

FIG. 8 (Cont.)

| Gene Name | Forward GSP | Reverse GSP |
|---|---|---|
| SUSD5 | AAGCGAGGGCATGACCCA | GCCCTCAGTCTCGGAAGCA |
| SV2A | CGTGACAGGGACGGGCGAA | ACAGTCAACACGTCCAGCGCA |
| SYT17 | GACCGGGGTCAAACGCAA | AATCAGCGCCTTCCACCA |
| TACSTD2 | CGGTATCGTCCCAGACCCAA | AGGAGACCCTGAGGCCAGGA |
| TAGLN | GCAGCTTGGCAGTGACCAA | CTGCCCATCTGAAGGCCA |
| TAT | CCATCCCTGGACTCCGGCCA | CTAACCGCTCCGTGAACTCCA |
| TBX21 | GGACTGAGATTGCCCCCA | GAGGAGCTGTCACCACTGGA |
| TBXA2R | GATGGCTCAGCTCCTGGGA | TCCAGGTGGCCACGCGCA |
| TBXT | CATGTGAAGCAGCAAGGCCCA | CCAGTCACCACTGGCTGCCA |
| TCTN2 | CACGTTGCAATGAGAGGCAA | CGGATGCTCAGGTGAGCA |
| TEK | AGAAGCGGCCTAGGACAGAACA | GGTCCCAGGTGTACAGCACA |
| TENM1 | AAGTCCAGCCTAGGGCAGCA | TGACCTCGGCTGCTGAACACA |
| TENM2 | GCGACCTGGTCACACTAGGCA | AGTCCTGCCGTTGACCAGCA |
| TF | CCGAAGACTGCATCGCCA | CTGCCAAGACAGGCACCA |
| TFPI | GTATGGTGGATGCCTGGGCAA | GTTGATTGCGGAGTCAGGGA |
| TFPI2 | CGGTGGGTGTCACCGGAA | TTGGTGCGCAGAAGCCCA |
| TGFB1 | TGCTTCAGCTCCACGGAGA | CCGAGGCAGAAGTTGGCA |
| TGFBR2 | AGCCCAGTGTGTGGCAGA | TAGGGAGCCGTCTTCAGGA |
| TGFBR3 | TCCTGCTCAACTCCCCACA | TGGACCACAGAACCCTCAGACA |
| TH | GTGCAGCCCTACCAAGACCA | CGCTGGATGCGTGAGGCA |
| THBD | GCAGCGCTGTGTCAACACA | GCTGGCACTGGTACTCGCA |
| THBS1 | ACTCGTGCCCAATCCCGA | TAACCTACAGCGAGTCCAGGA |
| THSD1 | CCTCAGAGTCGAGGTGCCCA | TTCCTCAAGGGCTGCCCCA |
| THSD4 | GGAACAACCGGCCGGCAGA | CCGCTCCCACACTCGATGGA |
| THSD7A | CAGCATCTGTGCCCAGAGCA | GACACCACACTGTTCGGGAAGA |
| THY1 | GACCCGTGAGACAAAGAAGCA | TGAAGGCGGATAAGTAGAGGA |
| TIE1 | GGCCCTCTCAGACTCCGAGA | GCCACCTGCACCTCCACA |
| TIGIT | AGGAGGAATGGAGCCCCA | GTCATGCAGCTCGGCACA |
| TIMP1 | CCGGGGCTTCACCAAGACCTA | TGGCTCCCGAGGCAGGCA |
| TLL1 | CCATGAGGCACTGGGAAAAGCA | CCTCGCCGACCTACATAGGA |
| TLL2 | TCGGATGCCTCAGTGCAGA | TCCCCAAACTGGGCGTGGGAA |
| TLR1 | GCTGGAACCCATTCCGCA | GCTGCCCTTAAGTTAGCCCA |
| TLR2 | GCAGCAAGCACTGGCCAA | CCGTGAGCAGGATCAGCA |
| TLR3 | CACAGGCCAGGAATGGAGA | AGGCTTGGGACCAAGGCA |
| TLR4 | TGGATCAAGGACCAGAGGCA | TGCAGCCAGCAAGAAGCA |
| TLR6 | CGTCACCATCGGTGCCACCA | TTCCTGGCCCTGCGCCGA |
| TLR9 | TGGCAGACTGGGTGTACAACGA | GCGGCTGCCATAGACCGA |
| TM2D1 | CGAGGACCTCAAAGTGGGACA | AAAAAGAGACAATGCGACTGCCA |
| TM2D3 | CTGCACGGTGCGGGACCA | CCAGGCCACCGAAGCTGA |
| TM9SF1 | CCGGCAGATTGGAGGCGA | CCGTCAGAAGCAGCAGGA |
| TM9SF3 | GAAATCTGTCAGGTCAGCCCAA | ACAGGATAACCAGCACCAGCA |

FIG. 8 (Cont.)

| Gene Name | Forward GSP | Reverse GSP |
|---|---|---|
| TMCO3 | TCCATCGAACCCATCCGCGA | GAAAACTCGCTGACCTGGGCA |
| TMED4 | GAAGGACCCCGACGGCAA | CATGCTCCCCAACCTGGA |
| TMED7 | GGGTGCAGGCTGCTCGCA | GTCAGGAAGCTCGAAGGTGA |
| TMED9 | AAGCAGCGGGAGGAGTACCA | TGAACCTGCCCTCGGAGCCA |
| TMEFF1 | CGGCGGCAAAGGCAAGAGCA | TACAAGCAGCCCTTCTGAGA |
| TMEM131L | CCGCCCTACCTCACAAGCA | GGGGTTGATGGGGCAGCA |
| TMEM132A | CCTGTGAGAGTGGGGGAGGA | GTCCTCACACACCCAGCGGA |
| TMEM132E | CCTACCCCATCCCACAGCCA | AGCTGCTGCCCCCACCTCCA |
| TMEM231 | CCTGAGGCTGCAGCAGAAGCA | CCTCTCCTGGTAGGCAGCAA |
| TMEM25 | ATCGACCAGGATGGGCCA | CTTCCACCCGGGTAGCCA |
| TMEM87A | AAACTTGGCAAGATGCACCA | ATCTCTCCAGTAGCAGGCAGA |
| TMEM87B | GCAACACTGGACTGTCAACCCA | ATCACGCCTTCAACAGCTGCA |
| TMEM8A | CCTCCGTCTACGCCTACACCA | AGGGCCCCAGCATGTTCCACA |
| TMEM9 | GCGAGTGCAGGTACGAGGA | CGGATCAGAGGGTCCACCA |
| TMIGD2 | CAGGGACGGCTCTCCTGGCA | CAGCCTCCTCCAACTCAGGAA |
| TMPRSS5 | GGGAGTCAGGACCCTCTCCA | TCCAGTGTACCCACCCCACA |
| TMX3 | CTGCGGCTCTGCGCCACA | TGGCCACACCATGGCGCA |
| TMX4 | TTGCAGGATGCGGAGGAGGAA | CTCTCCTCATCCACACCAGCA |
| TNC | AGGGGTACAGTGGGACAGCA | GCCCTTCCAGTGGAACCA |
| TNFRSF10B | AATAGCATGTGACACAGGACAGCCA | AGGGCAGAAGCATGAAAGGACACCA |
| TNFRSF10C | CACAGCTTCAAGGGGAGGA | TGCACGGGTTACAGGCTCCA |
| TNFRSF11A | CTGCACAGGCTGCCGGAA | AGCCTCCCATCAGCCCCA |
| TNFRSF11B | AGAAAGTGGGAGCAGAAGACA | ACAAACTGAGCAGCTTCAGGA |
| TNFRSF12A | ACGATGCCGCAGGAGAGAGA | ATCAGCGCCACAGCTGGGCA |
| TNFRSF13C | AGCCCCTGGACAAGGTCA | CCAGGAGGAGGCCAGGCA |
| TNFRSF14 | TGCAAGGAGGACGAGTACCCA | AGGCCATTGAGGTGGGCA |
| TNFRSF17 | CTGCATCAAGAGCAAACCGA | GCACTCAAAGCAGCTGGCA |
| TNFRSF18 | CAGGAGGGAGAGAGAGACACA | GCACTGCACACCCACGGACA |
| TNFRSF1A | AAGAGGGGGAGCTTGAAGGA | TGAAGGTGGAACTGGGCA |
| TNFRSF21 | AGAAGTCCAGCACGCCCA | TCCGGATACTGCACACCACA |
| TNFRSF25 | CCTTGGACAGCGCCCACA | ATGTCACCTGCGGGCAGA |
| TNFRSF4 | GCCCAGAACCTCACAGGGA | GGAGCAGGTACAGGGCCA |
| TNFRSF8 | CTGCATCACCCACAGCCGCA | CTCCCATCATGGGCGCCAGA |
| TNFRSF9 | TGGGACGAAGGAGAGGGA | GCAGTCGACGTCAGCGCA |
| TNFSF10 | GACCCAGCCTGGGACAGA | CGTAAGTTACAGCCACACAGAGA |
| TNFSF13 | CAGAGGTGATGTGGCAACCA | CTTCTCGAGACACCACCTGA |
| TNFSF14 | ACCCCGCTACCCCGAGGA | ACCGGGTACCATCACGCA |
| TNFSF18 | GGCCAAGTGGCTCCCAATGCA | TCTATGGTGTCCCCAACATGCA |
| TNFSF9 | GCAGCCCACCTGGACAGA | GGAGGTCAGCAGCAGGGA |
| TNXB | GCAATGAGGCCCTGCACA | GTCCCGATCACGGGCAGA |
| TPBG | ACAGAGGTAGTGCAGGGCAA | GGTCACAGTCCAGGTCAGCA |

FIG. 8 (Cont.)

| Gene Name | Forward GSP | Reverse GSP |
|---|---|---|
| TPSAB1 | TGGCGCCTACACGGGAGA | GTGCCATTCACCTTGCACA |
| TREM1 | CCAAGCTCCACCCAAGTCAA | GACCTCAGCGTGACAGCAA |
| TREML2 | GCCAGGGACCCAGGAGGA | CTGGTGCTGAGGTCCCCAGA |
| TRHR | CAGGTCACCAAGATGCTGGCA | AGCTTTCTGAAGGCTGCACGGA |
| TRIL | TGCCCCAACATGGCCAGAA | GCAGAGATCACCAAACCAGTGGA |
| TRPV2 | ACTGGGCTTCATGGGAGCAGA | GAGGAGCTGGACGGGCACA |
| TSHR | GCCCAGTACGCAGACTCTGAA | CCAGCTGCTGCAGAGTCACA |
| TSPAN7 | TGAGGACTTACACGGACGCTA | CTGCACACCACAGCAGCTCA |
| TSPAN8 | GTGGCGACAGGTATCCTAGGA | ATCAGCAGCTCCATTGACCA |
| TTYH2 | CGGCTCACAGTCCCCCGA | CGGAGACAGGGGCGTTGGA |
| TTYH3 | CCCGCACACCTGGCAGCAA | ACAGCTGTACAGGCTGGGCA |
| TUBB3 | TGAGGAGTATCCCGACCGCA | CACCAGCTGGTGGATGGACA |
| TXNDC15 | GGCAGCAGAAGAGGCCAA | GTCCTCAGCTTCCCCAGGAA |
| TYR | AATGGAACGCCCGAGGGA | CTACATCAGCTGAAGAGGGGA |
| TYRO3 | GCATGCTGGCAGAGGACA | CCAGCCACTTGACAGGCA |
| TYRP1 | GCACCGAGGATGGGCCAA | AACTTCCAAGCACTGAGCGA |
| UGT8 | ACCAGAGTACAGGCAAAAGGCA | TCGATTGACAGGGTGACCA |
| ULBP2 | CAGCTGGAGAATTACACACCCA | AAAGAGGAGGAAGATCTGCCCA |
| ULBP3 | CTGAGAGAGGTGGGGCAGA | CGAAGCTGAACTGCCAAGA |
| UMOD | CCAGGACAGATGCCCACA | CCGGAACATCTGGACGGA |
| UNC5A | CCACAACCTGCGCCTATCCA | GCAAGTACCGCTGCGTGCCA |
| UNC5B | TCCCACTGTCCATCCGCCAGA | AGCTTCCCAGAGGTCCAGGA |
| UNC5C | CAGCCTGTGAACATCAAGGCA | CTGAGACGTCATGCAGGGCA |
| USP9Y | CTCCAGAGGAACAAGGGCAA | GCAAAACAGGAACCACCCA |
| VAMP5 | GCAGCAGCGTTCAGACCAA | CAATCAGGATGATGAGCAGGA |
| VASN | CAGTGAAGGAAGCTCCCGGA | GGGGCCAAGACTAGAGTCACACA |
| VCAM1 | CCAGTTGAAGGATGCGGGA | AGAGCACGAGAAGCTCAGGA |
| VCAN | GGGCACAGACCACTGAGCA | CGGCAGCAGCTTCTCCAGA |
| VDAC1 | GGGTACAAGCGGGAGCACA | GGCCAGCCAGCCCTCGTA |
| VEGFC | ACAAGACCTGCCCCACCA | CCACAGCTGGCAGGCCGA |
| VIPR1 | GAACCCCAAATACCGGCA | GGCTTGGAAGCTGGAGGA |
| VNN1 | AATGTACCCAAGGAGCCTGAGA | CCTCATGCCCATAGCCCA |
| VNN2 | CCGTGTCAAGACCCCCACAGA | GGACATGTGGAGTCACGGGA |
| VSIG10 | CCAGCTGTCGGATGGCAA | AGCGTCACATTGCCCCCA |
| VSIR | CGAGGCCAAAGTCAGGCA | AGGGACAGGGTCCAGGGA |
| VSTM1 | CAGAGCTCGGCAGAAAACGA | TGCAGCTGAAGATGGCGA |
| VSTM4 | CTCCAGAAAAGGCGGAAGGA | CATAGTACTGCACCACCCGGA |
| VTN | CTGCCACCTGTGAACCCA | CCCAGCCAGTACTGAGCGA |
| VWF | ACTGCAGCTCAGCCCCAA | CAAGACACTGCTCCTCCAGGA |
| WNT11 | CGGGACACAAGACAGGCA | GGCAGGTGACGTAGCAGCA |
| WNT5A | ACAAGACGTCGGAGGGCA | TGCACTTGACGTAGCAGCA |

FIG. 8 (Cont.)

| Gene Name | Forward GSP | Reverse GSP |
|---|---|---|
| WNT5B | ACAAGACCTCGGAGGGCA | CGAAGCAGCACCAGTGGA |
| YBX1 | AGGGGCCCTCCTCGCCAA | TTGAAGTTGCGGCGGTACCGA |
| ZDHHC5 | GCAACGGGAAGCTGAGAGGCA | TCGTTCCTGGAGAGAGGCCA |
| ZFP42 | AGACCACGTCTGTGCGGA | TGGATGCGCACGTGCGTA |
| ZIC1 | CGCCAGCTCTGGCTACGAA | GTGGACTGCGGAGGAGGA |
| ZNF205 | CGGAAGAGCTTCAGCCACCA | AAGTCCGAGCGGCGGGTGAA |
| ZP4 | CTGGTCCAACAACCAACAACATGGA | GAGTGGCAGGGAACGTGACA |

MULTIPLEX PREPARATION OF BARCODED GENE SPECIFIC DNA FRAGMENTS

CROSS-REFERENCE TO RELATED APPLICATIONS

Pursuant to 35 U.S.C. § 119(e), this application claims priority to U.S. Provisional Application Ser. No. 62/765,124 filed on Aug. 17, 2018 and U.S. Provisional Application Ser. No. 62/799,448 filed Jan. 31, 2019, the disclosures of which applications are herein incorporated by reference.

INTRODUCTION

Multiplex polymerase chains reactions (multiplex PCR) include the simultaneous amplification of many DNA sequences in one reaction. Applications of multiplex PCR include, but are not limited to, the identification of mutations, gene deletions, and polymorphisms and the production or quantitation of amplicons for high throughput sequencing and genotyping. Multiplex reactions may include two or more target sequences with primer pairs or one template selectively amplified with primers designed to target specific regions. Additionally, such reactions may include multiple templates with regions multiplied by multiple primer pairs.

During multiplex PCR, proper amplification requires optimal conditions. It is important to maintain controlled cycling and annealing temperatures and fine-tuned relative concentrations of primers, buffers, dNTP's, Taq DNA polymerase, template and other PCR reagents. Common problems associated with multiplex PCR include: i) mis-priming due to nonspecific primer binding to non-target templates; and ii) the formation of unwanted side products due to the presence of multiple primer pairs. In conjunction with several other sensitive procedural variables, these issues may lead to cross hybridization, and uneven or no amplification of some target sequences. Unwanted multiplex PCR side products form in the presence of multiple primer pairs. These side products may include homodimers, formed by inter-molecular base pairing between two similar primers, and heterodimers, formed from inter-molecular interactions between sense and antisense primers. Another undesirable occurrence is the formation of hairpins and fold-back structures from intra-molecular interactions.

Furthermore, the technological problems with design of PCR primers and assay optimization are compounded in the analysis of small nucleic acid samples from large numbers of biological samples, like small amounts of clinical samples and in single cells. One of the best strategies of processing large numbers of biological samples is labeling of target nucleic acids (e.g. mRNAs) present in every sample with unique sample-specific barcodes, where the barcodes are employed to denote the source of each particular sample. These sample-specific barcodes can be used for deconvolution of the final multiplex profiling data and assigning these data to specific originating samples. Current RNA barcode labelling technologies are based on the mixing together of biological samples, e.g., from single cells, with universal (not gene-specific) sample-specific barcoded primers (e.g. oligo dT), e.g., present in a micro well or in a single droplet. The plurality (i.e., more than one) of barcoded oligo dT primers are commonly synthesized on the surface of beads using combinatorial phosphoramidite chemistry with one specific barcode labeled oligo dT primer per bead. In another strategy, the barcoded primers with unique barcodes are synthesized separately, optionally immobilized on the beads or encapsulated in a matrix (e.g. acrylamide) and deposited in a separate compartment (e.g., microwell). Each oligo dT primer with a sample-specific barcode (e.g., attached to the single bead) is annealed to the conservative polyA+ mRNA portion and extended by reverse transcriptase. As a result, the oligo dT-extended first strand cDNA molecules derived from one sample are labeled with a sample-specific barcode, and these cDNA molecules may then be mixed together with other barcode labeled cDNAs derived from other samples (e.g., cDNAs derived from 10,000 cells in the current 10× Genomics platform), where the resultant pooled mixture may then be amplified as a pool and analyzed for sequence and composition using next generation sequencing (NGS) protocols.

To date, known barcode labelling strategies can only be used in multiplex targeted PCR assays with a combination of forward gene-specific primers, which allow one to amplify and analyze only the 3'-end of RNA molecules. Unfortunately, non-coding 3'-end portions of mRNAs are highly promiscuous in different cell types and disease states. As a result, the design of gene-specific primers for the amplification of 3'-ends of mRNA molecules is highly problematic and there are significant obstacles to using this strategy for expression profiling in different disease states, e.g., for profiling different cancer cell types. Furthermore, the barcoded oligo dT primers cannot be directly applied for conventional multiplex PCR assay, employing two gene-specific primers (forward and reverse), as the barcoded domain of the oligo dT primers are not physically connected with any gene-specific primer or amplified products. Importantly, multiplex targeted PCR assay commonly employs set of hundreds-thousands of gene-specific primers. Therefore, it is technologically challenging to label such a plurality of primers with, e.g., 10,000 different sample-specific barcodes, and deliver each barcoded primer pool to different samples or cells.

In some instances, the multiplex PCR primers may also incorporate unique molecular identifiers (UMI), the highly complex (usually random) sequences which allow one to label each nucleic acid molecule used in the assay with molecule-specific identifiers. The UMIs are useful in identification and elimination of PCR duplicate biases introduced during multiplex amplification steps.

Although genome-wide analysis of nucleic acid compositions can be achieved by many known technologies, multiplex PCR is a unique technology which can be designed for analysis of hundreds or thousands of distinct nucleic acid molecules or their fragments. The complexity and composition of a nucleic acid pool which needs to be amplified and analyzed in such multiplex targeted PCR assays is dependent on specific application. As a result, reduction in complexity of analyzed nucleic acids provides dramatic improvement in the sensitivity and specificity of the assay for many critical applications, including single-cell analyses and clinical diagnostics. Combination of multiplex PCR assays with sample-specific barcodes is the next frontier in reducing cost and quality of the analysis of multiple biological samples for clinical and experimental research applications.

SUMMARY

Methods of preparing a plurality of sample-barcoded anchor-domain-flanked gene specific deoxyribonucleic acid (DNA) fragments from a template nucleic acid, e.g., ribonucleic acid (RNA), sample are provided. Aspects of the methods include employing a set of gene specific primer pairs, wherein each pair of gene specific primers is made up of a forward primer and a reverse primer, at least one of which includes a sample barcode domain. The methods find use in a variety of different applications, including high-throughput sequencing, e.g., expression profiling, applications, including of small biological samples, e.g., single-cells.

BRIEF DESCRIPTION OF THE FIGURES

FIG. 7 shows Table 1 which provides examples of suitable sequences for 18nt long barcode domains. The sequences in each vertical column from left to right are set forth in the following SEQ ID NO's: (i) 85-2104 (ii) 2105-4125 (iii) 4126-6106 (iv) 6107-8084.

FIG. 8 shows Table 2 which provides sequences of forward and reverse gene specific primers of gene specific primer pairs. The sequences are set forth in the following SEQ ID Nos: Forward: 8085-9444; Reverse: 9445-10640.

DEFINITIONS

Figure 1:
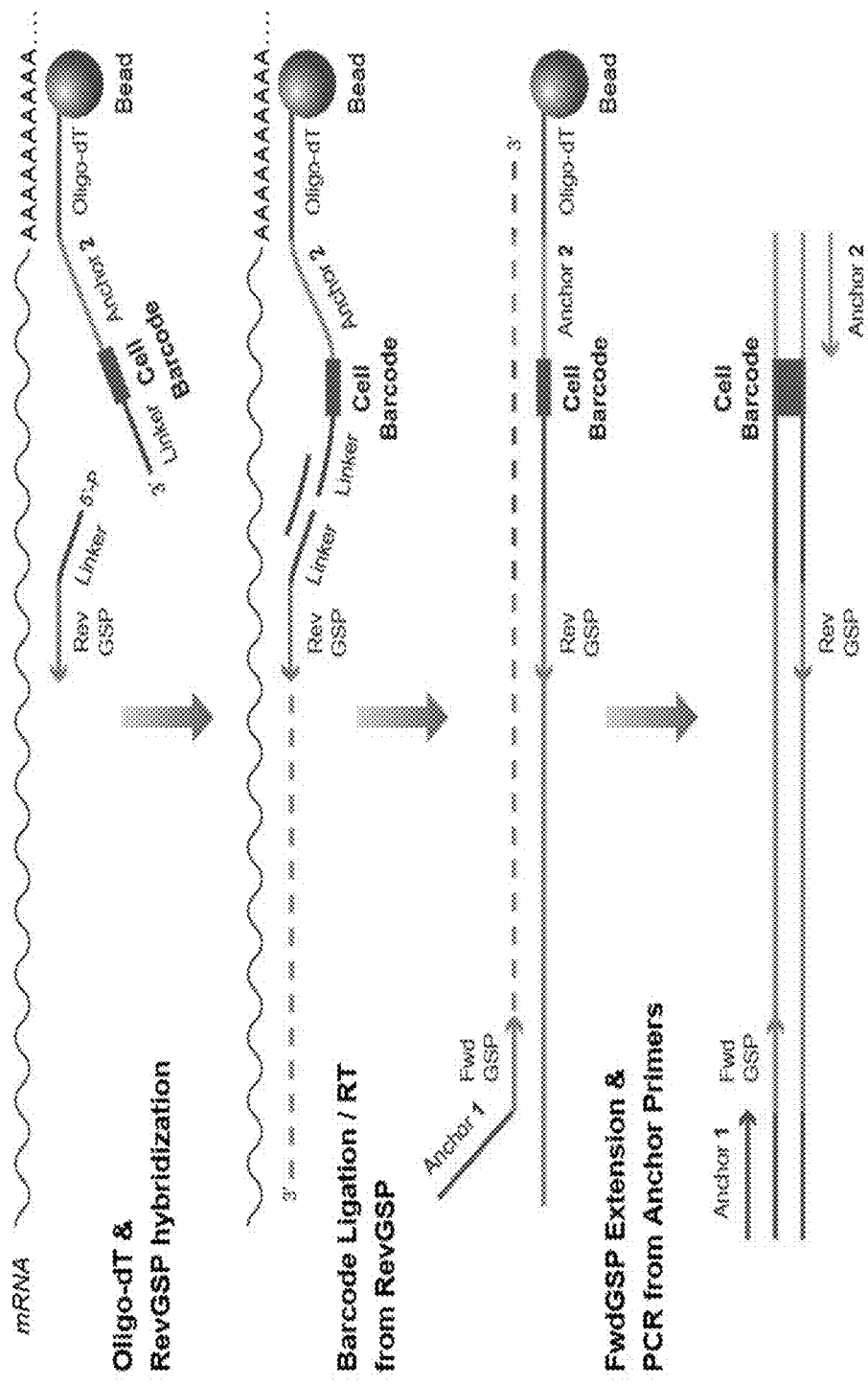
FIG. 1 provides a schematic diagram of a method of preparing a plurality of sample-barcoded anchor-domain-flanked gene specific deoxyribonucleic acid (DNA) fragments in accordance with an embodiment of the invention.

As used herein, the term "hybridization conditions" means conditions in which a primer, or other polynucleotide, specifically hybridizes to a region of a target nucleic acid with which the primer or other polynucleotide shares some complementarity. Whether a primer specifically hybridizes to a target nucleic acid is determined by such factors as the degree of complementarity between the polymer and the target nucleic acid and the temperature at which the hybridization occurs, which may be informed by the melting temperature ($T_M$) of the primer. The melting temperature refers to the temperature at which half of the primer-target nucleic acid duplexes remain hybridized and half of the duplexes dissociate into single strands. The Tm of a duplex may be experimentally determined or predicted using the following formula Tm=81.5+16.6(log 10[Na+])+0.41 (fraction G+C)−(60/N), where N is the chain length and [Na+] is less than 1 M. See Sambrook and Russell (2001; Molecular Cloning: A Laboratory Manual, 3rd ed., Cold Spring Harbor Press, Cold Spring Harbor N.Y., Ch. 10). Other more advanced models that depend on various parameters may also be used to predict Tm of primer/target duplexes depending on various hybridization conditions. Approaches for achieving specific nucleic acid hybridization may be found in, e.g., Tijssen, Laboratory Techniques in Biochemistry and Molecular Biology-Hybridization with Nucleic Acid Probes, part I, chapter 2, "Overview of principles of hybridization and the strategy of nucleic acid probe assays," Elsevier (1993).

The terms "complementary" and "complementarity" as used herein refer to a nucleotide sequence that base-pairs by non-covalent bonds to all or a region of a target nucleic acid (e.g., a region of the product nucleic acid). In the canonical Watson-Crick base pairing, adenine (A) forms a base pair with thymine (T), as does guanine (G) with cytosine (C) in DNA. In RNA, thymine is replaced by uracil (U). As such, A is complementary to T and G is complementary to C. In RNA, A is complementary to U and vice versa. Typically, "complementary" refers to a nucleotide sequence that is at least partially complementary. The term "complementary" may also encompass duplexes that are fully complementary such that every nucleotide in one strand is complementary to every nucleotide in the other strand in corresponding positions. In certain cases, a nucleotide sequence may be partially complementary to a target, in which not all nucleotides are complementary to every nucleotide in the target nucleic acid in all the corresponding positions. For example, a primer may be perfectly (i.e., 100%) complementary to the target nucleic acid, or the primer and the target nucleic acid may share some degree of complementarity which is less than perfect (e.g., 70%, 75%, 85%, 90%, 95%, 99%).

The percent identity of two nucleotide sequences can be determined by aligning the sequences for optimal comparison purposes (e.g., gaps can be introduced in the sequence of a first sequence for optimal alignment). The nucleotides at corresponding positions are then compared, and the percent identity between the two sequences is a function of the number of identical positions shared by the sequences (i.e., % identity=# of identical positions/total # of positions× 100). When a position in one sequence is occupied by the same nucleotide as the corresponding position in the other sequence, then the molecules are identical at that position. A non-limiting example of such a mathematical algorithm is described in Karlin et al., Proc. Natl. Acad. Sci. USA 90:5873-5877 (1993). Such an algorithm is incorporated into the NBLAST and XBLAST programs (version 2.0) as described in Altschul et al., Nucleic Acids Res. 25:389-3402 (1997). When utilizing BLAST and Gapped BLAST programs, the default parameters of the respective programs (e.g., NBLAST) can be used. In one aspect, parameters for sequence comparison can be set at score=100, wordlength=12, or can be varied (e.g., wordlength=5 or wordlength=20).

A "domain" refers to a stretch or length of a nucleic acid made up of a plurality of nucleotides, where the stretch or length provides a defined function to the nucleic acid. Examples of domains include Barcoded Unique Molecular Identifier (BUMI) domains, primer binding domains, hybridization domains, barcode domains (such as source barcode domains), unique molecular identifier (UMI) domains, Next Generation Sequencing (NGS) adaptor domains, NGS indexing domains, etc. In some instances, the terms "domain" and "region" may be used interchangeably, including e.g., where immune receptor chain domains/regions are described, such as e.g., immune receptor constant domains/regions. While the length of a given domain may vary, in some instances the length ranges from 2 to 100 nucleotides (nt), such as 5 to 50 nt, e.g., 5 to 30 nt.

By "primer extension product composition" is meant a nucleic acid composition that includes nucleic acids that are primer extension products. Primer extension products are deoxyribonucleic acids that include a primer domain at the 5' end covalently bonded to a synthesized domain at the 3' end, which synthesized domain is a domain of base residues added by a polymerase mediated reaction to the 3' end of the primer domain in a sequence that is dictated by a template nucleic acid to which the primer domain is hybridized during production of the primer extension product. Primer extension product compositions may include double stranded nucleic acids that include a template nucleic acid strand hybridized to a primer extension product strand, e.g., as described above. The length of the primer extension products and/or double stranded nucleic acids that incorporate the same in the primer extension product compositions may vary, wherein in some instances the nucleic acids have a length ranging from 50 to 1000 nt, such as 60 to 400 nt and including 70 to 250 nt. The number of distinct nucleic acids that differ from each other by sequence in the primer extension product compositions produced via methods of the invention may also vary, ranging in some instances from 10 to 25,000, such as 100 to 20,000 and including 1,000 to 10,000, 10,000 to 20,000, 15,000 to 20,000 and 15,000 to 19,000.

DETAILED DESCRIPTION

Methods of preparing a plurality of sample-barcoded anchor-domain-flanked gene specific deoxyribonucleic acid (DNA) fragments from a template nucleic acid, e.g., ribonucleic acid (RNA), sample are provided. Aspects of the methods include employing a set of gene specific primer pairs, wherein each pair of gene specific primers is made up of a forward primer and a reverse primer, at least one of which includes a sample barcode domain. The methods find use in a variety of different applications, including high-throughput sequencing, e.g., expression profiling, applications, including of small biological samples, e.g., single-cells.

Before the present invention is described in greater detail, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges and are also encompassed within the invention, subject to any specifically excluded limit in the stated range. Where the stated range includes one or both of the limits, ranges excluding either or both of those included limits are also included in the invention.

Certain ranges are presented herein with numerical values being preceded by the term "about." The term "about" is used herein to provide literal support for the exact number that it precedes, as well as a number that is near to or approximately the number that the term precedes. In determining whether a number is near to or approximately a specifically recited number, the near or approximating unrecited number may be a number which, in the context in which it is presented, provides the substantial equivalent of the specifically recited number.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, representative illustrative methods and materials are now described.

All publications and patents cited in this specification are herein incorporated by reference as if each individual publication or patent were specifically and individually indicated to be incorporated by reference and are incorporated herein by reference to disclose and describe the methods and/or materials in connection with which the publications are cited. The citation of any publication is for its disclosure prior to the filing date and should not be construed as an admission that the present invention is not entitled to antedate such publication by virtue of prior invention. Further, the dates of publication provided may be different from the actual publication dates which may need to be independently confirmed.

It is noted that, as used herein and in the appended claims, the singular forms "a", "an", and "the" include plural referents unless the context clearly dictates otherwise. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

As will be apparent to those of skill in the art upon reading this disclosure, each of the individual embodiments described and illustrated herein has discrete components and features which may be readily separated from or combined with the features of any of the other several embodiments without departing from the scope or spirit of the present invention. Any recited method can be carried out in the order of events recited or in any other order which is logically possible.

While the apparatus and method has or will be described for the sake of grammatical fluidity with functional explanations, it is to be expressly understood that the claims, unless expressly formulated under 35 U.S.C. § 112, are not to be construed as necessarily limited in any way by the construction of "means" or "steps" limitations, but are to be accorded the full scope of the meaning and equivalents of the definition provided by the claims under the judicial doctrine of equivalents, and in the case where the claims are expressly formulated under 35 U.S.C. § 112 are to be accorded full statutory equivalents under 35 U.S.C. § 112.

In further describing various aspects of the invention, embodiments of various methods will be discussed first in greater detail, followed by a review of various applications in which the methods find use as well as kits that find use in various embodiments of the invention.

Methods

As summarized above, methods of preparing a plurality of sample-barcoded anchor-domain-flanked gene specific deoxyribonucleic acid (DNA) fragments from a ribonucleic acid (RNA) sample are provided. Before describing the methods further, the product nucleic acids prepared the methods is now described first in greater detail.

Sample-Barcoded Anchor-Domain-Flanked Gene Specific DNA Fragments

By "sample-barcoded anchor-domain-flanked gene specific deoxyribonucleic acid (DNA) fragment" is meant a DNA that includes an anchor domain on each side of a gene specific domain. As the gene specific domain is flanked by anchor domains, the DNA fragments prepared by methods of the invention include a first anchor domain located at a first end of the DNA fragment and a second anchor domain located at a second end of the DNA.

By gene specific domain is meant a region of the dsDNA fragment the includes a sequence found in template nucleic acid, such as a template mRNA. While the length of the gene specific domain may vary, in some instances the gene-specific domain ranges in length from 50 to 500 nt, such as 60 to 300 nt.

In addition to the gene specific domains, as described above, the DNA fragments have anchor domains on either side of the gene specific domain. Anchor domains are domains that are employed in nucleic acid amplification, such as polymerase chain reaction (PCR), steps of the methods, where they serve as primer binding sites for the primers employed in such amplification steps. Where the amplification employed is PCR, the anchor domains may also be referred to as PCR primer binding domains. The length of the anchor domains may vary, as desired. In some instances, the anchor domains of each primer pair range in length from 10 to 50 nt, such as 10 to 30 nt, e.g., 10 to 24, including 12 to 20 nt. Where desired, the anchor domains may include PCR suppression sequences. PCR suppression sequences are sequences configured to suppress the formation of non-target DNA during PCR amplification reactions, e.g., via the production of pan-like structures. Such sequences, when present, may vary in length, ranging in some instances from 5 to 25 nt, such as 7 to 21, including 7 to 20 nt. PCR suppression sequences of interest include, but are not limited to, those sequences described in U.S. Pat. No. 5,565,340; the disclosure of which is herein incorporated by references. An example of forward and reverse anchor domains that include PCR suppression sequences are: AGCACCGACCAGCAGACA (SEQ ID NO:01) and AGACACGACCAGCCACGA (SEQ ID NO:02).

As summarized above, the DNA fragments are also "sample-barcoded", by which is meant that they include a barcode domain that denotes, i.e., indicates or provides information about (such that it may be used to determine), the specific sample, e.g., cell, from which the fragment has been produced. Barcode domains include unique, specific sequences. While the length of a given barcode domain may vary, in some instances the length ranges from 6 to 30 nt, such as 8 to 20 nt, and including 12 to 18 nt. Examples of suitable sequences for 18nt long barcode domains are provided in Table 1 in FIG. 7.

In addition to the gene-specific, barcode and anchor domains, the fragments produced by methods of the invention may further include a unique molecular index (i.e., unique molecular identifier or UMI) domain. UMI domains have sequences configured for labeling of the each in the plurality of RNA molecules (and extended cDNA product) present in the hybridization mix with different molecule-specific indexes. UMI domains are stretches of random or semi-random nucleotides. While the lengths of UMI domains may vary, in some instances the length of a UMI domain ranges from 8 to 20 nt, which in a given assay provides for complexity of different unique sequences of 10,000 or more different UMIs. In some instances, using at least 10,000 unique indexes is sufficient to label each template molecule with the same sequence with a unique index, i.e., UMI. By analyzing the number of the indexes, e.g., via NGS, the number of each unique template molecule with the same sequence employed in multiplex PCR assay can be calculated. In some instances, the UMI domain may be combined with the barcode domain, e.g., where the UMI nucleotides are interspersed with the barcode nucleotides in a BUMI domain, e.g., as described in United States Patent Application Publication No. US20150072344, the disclosure of which is herein incorporated by reference.

Also present in the DNA fragments produced by methods of the invention may be ligated linker domains. Ligated linker domains are domains having sequences found in first and second linker domains employed in methods of the invention, e.g., as described in greater detail below. In the ligated linker domain, the sequences of the first and second linker domains are joined to each other, such that the sequence of one of the linker domains begins at the end of the other linker domain. The length of the ligated linker domain may vary, and in some instances ranges 15 to 60 nt, such as 20 to 50 nt, and including 24 to 40 nt. While not required, in some cases the ligated linker domain has a sequence with a GC-content in the range 50% to 80%.

As indicated above, the methods are methods of preparing a plurality of sample-barcoded anchor-domain-flanked gene specific DNA fragments from a template nucleic acid sample, e.g., a template ribonucleic acid (template RNA) sample. More specifically the methods are multiplex methods of preparing a plurality of sample-barcoded anchor-domain-flanked gene specific deoxyribonucleic acid DNA fragments from a template nucleic acid, e.g., RNA, sample, such that each DNA fragment of the plurality is produced at the same time from the RNA sample, e.g., each DNA fragment is produced simultaneously from the source RNA sample. The number of distinct DNA fragments prepared in a given method may vary, where in some instances the number in the plurality ranges from 10 to 25,000, such as 100 to 20,000 and including 1,000 to 10,000, 10,000 to 20,000, 15,000 to 20,000 and 15,000 to 19,000.

Among the DNA fragments of the plurality that are produced from a single sample by methods of the invention, a given DNA fragment is considered to be distinct from another DNA fragment if the gene-specific domains of the two fragments differ from each other by sequence. While the gene-specific domains of the DNA fragments in a given plurality may all differ from each other, e.g., because they include coding sequences of different genes, the DNA fragments will also include common domains, i.e., domains that are identical to each other (i.e., domains having sequences that do not differ from each other), where these domains are the flanking anchor domains, the barcode domains and the ligation linker domains. When employed, the DNA fragments may further differ with respect to additional domains, such as distinct UMI domains, such that the UMI domains of the DNA fragments have different sequences, i.e., they are not common or identical.

As indicated above, during a given protocol a plurality of DNA fragments produced from one sample may be combined, i.e., pooled, with one or more additional pluralities produced from one or more additional samples. In such pooled compositions, each plurality of the pooled composition will have a distinct barcode domain, such that the barcode domain of a first plurality of the composition will have a sequence that differs from every other barcode domain of every other plurality in the pooled composition. In a given pooled composition, each barcode domain has a sequence that is significantly different from that of any other barcode domain in the pooled composition, with a difference of at least 1 nucleotide, such as 2 nucleotides and including 3 or more nucleotide differences in the whole set of barcodes employed in the assay. In this way each plurality of the pooled composition will have a distinct identifying barcode domain. The number of different barcode domains in such pooled compositions is the same as the number of different pluralities in the pooled composition, where the number represents the number of different samples that is employed to make the pooled composition. The number of different barcodes present in a given pooled composition depends on number of samples being analyzed in a given assay. In some instances, the number ranges from 10 to 1,000,000, such as 100 to 100,000, and including 1,000 to 10,000. For example, currently for analysis of single-cell samples, the number of barcodes may be 10,000 or more, but for analysis of clinical samples the number of barcodes may not exceed 1,000.

Gene Specific Primers

As summarized above, in embodiments of the invention a set of gene specific primers, i.e., a collection of gene specific primer pairs of known sequence, is employed. While the number of primer pairs in a given set may vary, as desired, in some instances the number of primer pairs in a given set is 10 or more, such as 20 or more, 30 or more, 40 or more, 50 or more, 60 or more, 70 or more, 80 or more, 90 or more, 100 or more, 125 or more, 250 or more, 500 or more, including 1000 or more, 200 or more, 5000 or more, 8000 or more, 10,000 or more 15,000 or more, 18,000 or more and 20,000 or more. In some instances, the number of gene specific primer pairs that is present in the set is 25,000 or less, such as 20,000 or less. As such, in some embodiments the number of gene specific primer pairs in the set that is employed in the methods ranges from 10 to 25,000, such as 50 to 20,000, including 1,000 to 10,000, e.g., 2,500 to 8,500, and 10,000 to 20,000, e.g., 15,000 to 19,000.

Gene specific primer pairs present in a given set of the invention are made up of a forward primer and a reverse primer, wherein the forward and reverse primers of each primer pair include gene specific domains, where these gene specific domains may be experimentally validated as suitable for use in a multiplex amplification assay. By "experimentally validated as suitable for use in a multiplex amplification assay" is meant that the set of primers for each target gene in a given set has been experimentally tested in a multiplex amplification assay, such as described in U.S. patent application Ser. No. 15/133,184 published as US-2016-0376664-A1 and U.S. application Ser. No. 15/914, 895 published as US-2018-0245164-A1 (the disclosures of which are herein incorporated by reference), and the best performing primer set is selected based on parameters, e.g., one or more functional parameters, e.g., as described in greater detail below. While the multiplex amplification assay employed to experimentally validate a set of primers may vary, in some instances the protocol employed includes a first step of, for each target gene selected from the genome-wide set of human or mouse genes, selecting a region that is conservative for different mRNA isoforms, following which a set of forward and reverse PCR primers which are complementary and specific for the selected gene region are designed. The primers may be designed using any convenient algorithm and/or software tool, e.g., such as the Primer3 algorithm, Primer Design Tool from NCI, etc. The melting temperature of the selected primers may vary, ranging in some instances from 60° C. to 80° C., such as 65° C. to 80° C. Furthermore, the primers may be selected that lack significant secondary structures, or self-complementarity (e.g., primers may be selected with less than 4-bp complementary regions) and cross-complementarity to each other of less than 10 nt complementarity region. The length of the selected PCR primers may vary, and in some instances ranges from 15 to 25 nt, such as 16 to 24 nt, with GC-content of between 45% to 85%, such as 50% to 75%. In order to avoid primer/dimer formation in a multiplex RT-PCR assay, the selected primers in some embodiments are designed with the nucleotide A at the 3'-end and biased GCA-rich composition with reduced percentage of T nucleotides, where in some instances the percentage of T is 20% or less, such as 15% or less, including 10% or less, down to 0%. Following primer design, homology searching for similar PCR primer binding domain(s) in other RNA species (such as available in GeneBank), e.g., via BLAST or Thermo-Blast algorithm, is performed in order to select primers specific only to the target region of interest. Next, the resultant primer set is ranked based on the distance between primers with the preferred size of amplicons, e.g., which ranges in some instances between 60 to 250 base pairs (bp). Following this ranking, a set of at least 1 primer pair, such as 3 or more, e.g., 5 or more, up to 12 or more, but in some instances not exceeding 12 primer pairs, is synthesized and functionally validated in a multiplex Reverse Transcription (RT)-PCR-NGS (next generation sequencing) assay, e.g., using the protocol disclosed in the Experimental section, below. In some embodiments, e.g., those specific for mutation profiling in clinically actionable or cancer driver genes, a complete set of PCR primers is designed and validated which allows one to amplify a set of overlapping amplicons that cover the complete mRNA sequence from the 5' to the 3'-end. Primers present in sets of gene specific primers of the invention may be experimentally validated using any convenient protocol. In some instances, the experimentally validated gene specific domains are validated in a multiplex amplification assay with a synthetic control template mix which mimics the natural target template sequences and includes binding sites for the whole set of gene-specific primer pairs and/or a universal natural template mix derived from multiple different mammalian tissues or cell types. Specifically, as a template for multiplex RT-PCR assay, a set (usually between 3 to 6) of natural total universal RNAs, e.g., including a mix of several RNAs isolated from human or mouse cell lines or tissue samples (e.g., available from Takara-Clontech, Agilent, Qiagen, Origene, etc.) may be employed as a natural nucleic acid control. In addition (or alternatively) to the set of the natural control template nucleic acids, a mix of the synthetic control template nucleic acids, e.g., one that has been synthesized on the surface of custom microarrays (e.g., Custom Array or Agilent) and designed for each target amplicon, may be employed. In such synthetic control templates, the templates include the sequence of the both PCR primer-binding site domains and the full-length or truncated in the middle cDNA region between PCR primers that corresponds to the primer extension domain. In some functional validation assays, two synthetic template concentrations (e.g., 10-fold difference) may be employed to measure expression level (number of specific reads) in a manner that is not dependent on the amount of starting universal RNA template. The length of synthetic control templates may vary, ranging in some instances from 100 to 200, such as 110 to 180, including 120 to 160 nt. The amplification products generated in the multiplex RT-PCR assays may be quantitatively analyzed by sequence analysis using conventional NGS instruments (e.g., available from Illumina, Thermo-Fisher, Nanopore and other commercial vendors). The NGS data generated for different templates and experimental conditions may be scaled to the same number of total reads (usually total 10,000,000 reads), aligned with the sequences of PCR primer domain and downstream extended domain sequences for each target amplicon. The number of specific reads corresponding to each target amplicon may be measured as the number of correctly aligned sequences for each PCR primer pair and downstream extended domain sequences. In addition, for each primer pair, the number of non-specific (off-target) reads for the amplicons may be calculated which has correct the PCR primer domain but different, non-target extended domain sequences. The set of PCR primer pairs designed for each target gene may then be ranked using the set of criteria described below. The highest rank PCR primer pair for each target gene is first selected based on the highest number of specific reads (e.g., 100 or more, such as 500 or more and including 1,000 specific reads) and minimum number of non-specific reads (e.g., 2-fold less than number of specific reads, but not exceeding 5,000, or such as 2,000 reads) measured across all universal RNAs and control synthetic template. Next, the highest activity PCR primer set may be selected from among other primers that demonstrate a common pattern of expression among different natural universal RNAs used in the assay. Common pattern of expression between different primers sets indicates that they target the same conservative cDNA region, rather than a unique target region specific for particular mRNA isoform(s). In some embodiments, human PCR primers are selected that effectively amplified target regions from human but not from the mouse universal RNAs. In other embodiments, e.g., those specific for detection of clinically actionable mutations, not one but a complete set of PCR primers are selected which amplify amplicons overlapping the whole mRNA/cDNA sequence. In some embodiments, specific activity of primers is assayed at thermocycling extension temperatures of both 60° C. and 65° C. Using these two different conditions enables the identification of primer pairs that demonstrate similar (e.g., less than 2-fold difference) specific activity across several control templates and universal RNAs. In some instances, if a PCR primer set with high specific activity in both control synthetic template (e.g., less than 500 reads) and in all universal RNAs (e.g., less than 100 reads) for any target gene is not identified, a new candidate PCR primer set for the failed gene(s) is designed and validation protocol repeated until a suitable set is found. As a result of functional validation experiments, one can select at least one PCR primer set for each target gene of interest that has high sensitivity and selectivity, e.g., for at least 90%, such as 95% or more target genes of interest.

Each pair of gene specific primers are configured to hybridize to a target nucleic acid sequence for which they are specific at locations that are separated by a known or predetermined distance, i.e., a template distance. The length of the template distance may vary, ranging in some instances from 50 to 750 bp, such as 60 to 500 bp, including 60 to 300 bp, e.g., 70 to 250 bp. As such, the product nucleic acid produced from the gene specific primers may have a central domain, i.e., extension domain, complementary to the template nucleic acid from which it is produced (that is, identical to the reverse-complement sequence of the template nucleic acid from which it is produced) that varies in length, ranging in some instances from 50 to 750 nt, such as 60 to 500 nt, including 60 to 400 nt, e.g., 60 to 300 nt, including 80 to 200 nt.

A given gene specific primer may include a multiplex experimentally validated gene specific domain, e.g., as described above. The length of the gene specific domain may vary, so long as the domain serves to specifically hybridize to a target nucleic acid under hybridization conditions of interest. An example of such hybridization conditions is hybridization at 50° C. or higher and 0.1×SSC (15 mM sodium chloride/1.5 mM sodium citrate). In some embodiments, these hybridization conditions may be defined by length and nucleotide sequence of the gene-specific domains of the PCR primers, composition of PCR buffer, properties of DNA polymerase and conditions used in the primer extension step. Furthermore, hybridization conditions could be compatible with primer extension conditions, e.g., where both hybridization and extension step performed in DNA polymerase reaction buffer (e.g. 1×HF or 1×GC buffer from Thermo-Fisher). In another embodiment, where the hybridization step and primer extension step are separate steps in the protocol, the hybridization buffers could contain additional components for increasing hybridization rate (e.g., CTAB, PEG, high salt concentration (e.g., 1M or more), etc.), lysing the cells, denaturing proteins, stabilizing RNA, protein (detergents, guanidium salts, urea, PMSF, 2-mercapoethanol, etc.). If reverse barcoded primers are hybridized with target template RNA composition in cell extracts (e.g., single cells), the hybridization buffer could be optimized by highly denaturing conditions to stabilize the RNA. Furthermore, the reverse barcoded primers may be longer (such as 25-80 nt, such as 30 to 70 nt) than regular PCR primers to facilitate highly specific and stable interaction with target RNAs at elevated temperatures (e.g., 50° C. to 80° C.). Furthermore, the use of stringent hybridization conditions and the removal of non-binding primers permits the formation of specific complexes between reverse gene specific primers and target RNAs. Therefore, the specificity of extension of reverse barcoded primers could be significantly defined by hybridization rather than follow-up primer extension step specificity. Primer extensions temperatures may vary, ranging in some instances from 50 to 75, such as 60 to 72° C. As disclosed in Experimental section below, in one of the embodiments a primer extension step is employed in which extension occurs between 60 and 65° C. using Phusion II DNA polymerase, HF or GC buffer reagents available from Thermo-Fisher. Both the length and the specific nucleotide sequence of the PCR primers define the hybridization condition at the primer extension step. In some embodiments, the length and specific sequence of the gene specific domains of the PCR primers is selected in order to provide efficient binding and extension at 60 and 65° C. under the PCR conditions used in the primer extension step. Such conditions may provide or high efficiency and specificity of the primer extension in PCR reaction conditions. In some embodiments, the primer length and sequence may be adjusted to perform an extension step at 68° C. or even 72° C.

To control efficiency and specificity of primer extension step, the length of the gene specific domain of the forward and reverse primers may vary. In some instances, the length ranges from 10 to 80 nt, such as 15 to 75 nt, e.g., 10 to 50 nt, such as 10 to 30 nt, including 14 to 22 nt or 16 to 24 nt. The gene specific domain of the forward and reverse primers may vary length. In some instances, the gene specific domain of the forward domains is shorter than the gene specific domain of the reverse primers. For example, in some instance the length of the gene specific domain in the forward primers ranges from 15 to 30 nt, such as 18 to 25 nt, while the length of the gene specific domain in the reverse primers ranges from 25 to 80 nt, such as 30 to 70 nt, including 30 to 50 nt. Each primer of the gene specific primer set may include only a gene specific domain, or may include one or more additional domains as desired, e.g., anchor domains, NGS adaptor domains, labels or label domains, etc., e.g., as described below. In some embodiments where additional domains are present, each primer pair may include primers ranging in length from 10 to 150 nt, such as 10 to 100 nt, including 10 to 75 nt, such as from 15 to 60 nt, including from 24 to 45 nt.

Where desired, the gene-specific primer domain of each primer is GCA- and/or GCT-rich. By GCA- and/or GCT-rich is meant that the gene-specific primer domain has a substantial portion of G, C, A- and/or G, C, T nucleotides. While the number of such nucleotides in a gene specific primer domain may vary, in some instance the number of such sequences ranges from 75% to 100%, such as 85% to 100%. As the gene specific primer domains of such embodiments are GCA- and/or GCT-rich, the GC content of the gene specific primer domains is also high. While the GC content may vary, in some instances the GC content ranges from 40 to 90%, such as 45 to 85%, including 50 to 85%, e.g., 50 to 80%.

Depending on the specific application for which the set is configured, the set of gene specific primers may be configured to target a wide range of mammalian genes, and pathogenic genes from a wide range of pathogenic organisms, such as viruses, bacteria, fungi, etc. which could be present in the human or mammalian bodies. Of interest in certain applications are human, mammalian species commonly used as a model organisms to study human diseases, such as mouse, rat, or monkey, and pathogenic organisms associated with human diseases. To be analyzed in accordance with embodiments of the invention, the targeted genes may be present in the mammalian cells or fluids. In some embodiments, the targeted genes are may be protein coding, or may express non-coding RNAs, micro RNAs, mitochondrial RNAs, regulatory RNAs, etc. In some instances, the set of genes selected is genome-wide, such that it covers all genes present in the genome of an organism. In other embodiments, the genes are selected from the genes that could be transcribed or expressed in the organism and present in the biological samples in the form of RNA. The genome-wide set of genes specific for human, model and pathogenic organisms is of special interest in some instances and may be used to develop a set of genome-wide targeted RNA expression assays based on the disclosed multiplex PCR assay. Genome-wide sets of PCR primers may vary in number, and in some instances are configured to assay 18,000 or more, such as 20,000 or more and 25,000 or more, such as 30,000 or more genes. Additional sets of PCR primers may be configured based on a genome-wide set of genes from a wide range of viral, bacterial and eukaryotic pathogenic organisms. In another embodiment, the set of gene specific primers may be configured to produce primer extension products from a subset of specific genes selected from the genome-wide set of genes. One of these subsets is the set of cancer associated genes, that is, the genes that have been shown to be associated with initiation, development, diagnostic, treatment of cancer. Such genes could be implicated in, or be diagnostic of, or otherwise of interest in, the study and/or treatment of cancer, i.e., any of various malignant neoplasms characterized by the proliferation of anaplastic cells that tend to invade surrounding tissue and metastasize to new body sites. As such, cancer associated genes that may be represented in a given set of gene specific primers include, but are not limited to: cancer hallmark genes, pan-cancer driver genes, pathway and signaling network genes, drug metabolism genes, extracellular proteome genes, drug target genes (including those of FDA approved and/or clinical trial targets), cell lineage genes, immunity mechanisms & immunotherapy markers, immunotherapy drug target genes, known biomarkers, epigenetics genes, etc.

In another embodiment, the subset of the cancer associated genes is employed in developing of Cancer Clinically Actionable 26 assay for profiling all clinically actionable mutations in the set of 26 human genes (ABL1, AKT1, ALK, BRAF, CDK4, CDK6, CDKN2A, EGFR, ERBB2, FGFR1, FGFR2, FLT3, KDR, KIT, KRA, MET, NRAS, PDGFRA, PIK3CA, PIK3R1, PTCH1, PTEN, PTPN11, RET, ROS1, SMO). This assay includes the additional set of multiplex PCR primers designed and validated to amplify the set of overlapping amplicons that cover the whole mRNA sequence of the target genes.

In another embodiment, the multiplex PCR assay is designed for analysis of a subset of cell-specific, tissue-specific or state-specific genes. These genes encode marker products (e.g. proteins, peptides or RNAs) that are specifically expressed in different cell types (e.g. markers for T, B, NK, stromal, cancer, epithelial, neuronal, etc. cells), different tissues or different cell states, e.g. marker products induced by treatment (e.g. drugs) or changes in conditions (e.g. heat shock), disease states (e.g. cancer, infection), or natural biological processes (e.g. differentiation, apoptosis, aging, etc.). The development of multiplex PCR assay, based on the set of gene-specific primers specific for the marker genes, may be employed in the development of prognostic and predictive clinical diagnostic tools, profiling different cell types and their phenotypes in normal and disease states. For a marker gene analysis assay, the set of gene specific primer pairs includes primers configured to produce primer extension products for 10 or more genes listed in Table 2 (FIG. 8). As such, the set of gene specific primers employed in a given method may represent at least some of the genes listed in Table 2(FIG. 8), such that the set may include primer pairs that correspond to at least some of the genes listed in Table 2(FIG. 8).

A primer pair is considered to correspond to a given gene if the primers of the pair specifically hybridize to sequences of the gene. It is understood based on the current prior-art knowledge, the selected primer pair sequences could include all or only portion of the primer sequences (e.g. disclosed in the Table 2(FIG. 8)), so long as they provide for the desired gene specificity. Modification in the specific sequences of the PCR primers, such as mutations, deletion, extensions, using nucleotide analogs, etc., may be present so long as the functionality of the primers in the primer extension step is maintained. The number of genes from Table 2(FIG. 8) represented in the set of gene specific primers may vary, ranging from 10 to 10,000, including 25 to 10,000, 50 to 10,000, 100 to 10,000, where in some instances the number is 150 or more, such as 200 or more, 250 or more, 500 or more, 1,000 or more, up to and including all of the genes listed in Table 2. In some instances, the set of gene specific primers includes primer pairs having gene specific sequences listed in Table 2(FIG. 8). The number of gene specific primer pairs having gene specific sequences listed in Table 2(FIG. 8) that may be present in a given set of gene specific primers may vary, where in some instances the number ranges from 10 to 10,000, including 25 to 10,000, 50 to 10,000, 100 to 10,000, where in some instances the number is 150 or more, such as 200 or more, 250 or more, 500 or more, 1,000 or more, up to and including all of the primer pairs listed in Table 2. Subsets of the genes listed in Table 2 that may be employed in a given assay may vary. Specific subsets of interest that may be employed in a given assay include but are not limited to: cell-specific markers, disease-specific markers, tissue-specific markers, or any specific set of genes selected based on specific functions, expression, or association with human diseases, and the like. Essentially any combination of primers, including all the primers, identified by the sequence identifiers provided in Table 2(FIG. 8) may be assembled to form a set or subset of primer pairs of the present disclosure.

Sets and subsets of primer pairs may be configured to include or exclude multiple primer pairs for a particular gene. For example, a set or subset of primer pairs may include no or essentially no two or more primer pairs that target the same gene. Correspondingly, a set or subset of primer pairs may include two or more different primer pairs that target the same gene. Where two or more primer pairs for a particular gene are included in a set or subset, the primer pairs may or may not share the same forward primer or the same reverse primer. For example, in some instances, two primer pairs for a single gene may include the same forward primer but have different reverse primers, the same reverse primer but have different forward primers, or have different forward primers and different reverse primers.

As described above, in some instances, a set or subset of primer pairs may be configured such that no two primer pairs target the same gene, i.e., there is only one primer pair for each gene included in the set or subset. In some instances, the number of different primer pairs targeting the same gene may be low, including but not limited to e.g., 10 or less primer pairs targeting each gene of the set or subset, such as 5 or less, 4 or less, 3 or less or no more than 2 primer pairs targeting each gene of the genes of a set or subset. In some instances, 10% or less of the genes of a set or subset may be targeted by more than one primer pair, including 8% or less, 7% or less, 5% or less, 3% or less, 2% or less and 1% or less.

In some instances, the methods include selecting the set of gene specific primers from a provided master library of gene specific primers, e.g., choosing a subset of primer pairs from an initial collection of primer pairs. For example, the methods may include selecting a subset of primer pairs (and thereby identify the primer pairs of a set of gene specific primers to be employed in methods of the invention, such as described above) that correspond to genes from Table 2, where the number of primer pairs in the selected subset may vary, ranging in some instances from 10 to 10,000, including 25 to 10,000, 50 to 10,000, 100 to 10,000, where in some instances the number is 150 or more, such as 200 or more, 250 or more, 500 or more, 1,000 or more.

The disparate primer pairs of a given set are present in substantially the same, if not the same amount. As such, in some instances, the copy number of any given primer pair in a set does not vary from the copy number of any other primer pair of the set by a value of 100% or less, such as 50% or less. A given primer pair may be present in a set in any desired amount, where in some instances the amount ranges from 1% to 1000%, such as 5% to 500%, or 10% to 500%. The final concentration of each primer in the primer extension step may vary, and in some instances ranges from 0.01 to 50 nM, such as 0.01 to 20 nM, or 0.01 to 10 nM, where examples of specific concentrations of interest include 0.01 nM, 0.1 nM, 1 nM, 2 nM, 5 nM, 10 nM, 20 nM and 50 nM.

The sets of gene specific primers, e.g., as described above, are non-naturally occurring compositions. In some instances, the sets of gene specific primers include domains or regions that are not naturally occurring sequences and/or are not naturally joined to the gene specific primer domains in naturally occurring nucleic acids. For example, the gene specific domains may be joined to one or more synthetic domains, e.g., universal primer binding site domains, indexing domains, barcode domains, adaptor domains, anchor domain, linker domain, etc. In some instance the gene specific primers may include one or more moieties that are not present in naturally occurring nucleic acids, e.g., label moieties (e.g., directly detectable labels, such as fluorescent labels, indirectly detectable labels, e.g., components of a signal producing system, etc.), non-naturally occurring nucleotides, etc.

Depending on the particular protocol, the forward and reverse primers of the pairs of the sets of gene specific primers may be used together or separately. As such, a given method may include using the forward and reverse primer subsets of a given set separately, such as in methods where a template composition is first contacted with a subset of the reverse primers of a set, and then contacted with a subset of the forward primers of the set. Alternatively, a given method may include contacting a template both the forward and reverse primer subsets of a given set of gene specific primers at the same time.

The methods of the invention are characterized by employing a set of gene specific primer pairs, wherein each pair of gene specific primers is made up of a forward primer and a reverse primer and at least one of the forward and reverse primers includes, at some time during the method, a sample barcode domain. In some instances, the methods are characterized by employing: a sample-barcoded donor nucleic acid that includes an anchor domain and a sample barcode domain, wherein the sample-barcoded donor nucleic acid is employed in conjunction with a set of gene specific primer pairs, wherein each pair of gene specific primers is made up of a forward primer and a reverse primer and the methods include transferring at least the sample barcode domain to one of the forward and reverse primers. In other instances, the methods are characterized by employing a set of gene specific primers in which the reverse primers include a sample barcode domain.

Sample-Barcoded Donor Nucleic Acid Mediated Protocols

A sample-barcoded donor nucleic acid is an initial nucleic acid from which the sample barcoded domain of the DNA fragments is derived. In other words, the sample-barcoded donor nucleic acid serves as the source of the barcode domain of the final sample barcoded DNA fragments. Since the sample-barcoded donor nucleic acid serves as the source of the sample barcode domain, the sample barcode domain does not need to be incorporated into any of the gene specific primers employed to produce gene specific fragments from a template nucleic acid sample. A sample-barcoded donor nucleic acid includes a sample barcode domain and an anchor domain, e.g., as described above. In addition, a give sample-barcoded donor nucleic acid may include a linker domain and/or a UMI domain, e.g., as described above.

In some instances, the donor nucleic acid includes a capture domain. In some such instances, the sample-barcoded donor nucleic acid includes a template, e.g., an RNA, template-binding or capture domain, an anchor domain, and a barcode domain, and optionally a linker domain and/or a UMI domain. The template-binding domain is the sequence necessary for binding barcoded oligonucleotide to template, like DNA or RNA. Examples of template-binding domains include but are not limited to oligo dT sequences, e.g., for binding to polyA tails of mRNA molecules with number of dT nucleotides between 15 to 35, random oligonucleotides with a length of randomly synthesized A, T, G or C between 6 to 30 nucleotides, or semi-random oligonucleotides with length between 6 to 18 nucleotides designed against conservative regions in target templates, e.g. stretches of the nucleotides coding triplets for the most abundant amino acids, splicing sites, etc. Where the target RNA template molecule is mRNA, the RNA binding domain may be a poly dT sequence that hybridizes to the mRNA polyA tail. The length of the RNA binding domain may vary, and in some instances ranges from 10 to 40 nt, such as 15 to 35 nt, including 20 to 30 nt. The linker domain is a domain having a sequence configured for binding and/or ligation with linker domain present in another component of the assay, such as a gene specific primer, e.g., as described below. While the length of a given linker domain may vary, in some instances the length ranges from 5 to 30 nt, such as 10 to 25 nt, including 12 to 20 nt. There are no special requirements for nucleotide composition or sequence of the linker domain, but in some instances the linker domain is selected with GC-content in the range 50% to 80% without significant secondary structure within the domain or with other domains present in the oligonucleotide. In addition to the RNA binding domain, the anchor domain, barcode domain and linker domain, the donor nucleic acid may also include a UMI domain, e.g., as described above. In such instances, a given assay may employ a plurality of donor nucleic acids that have common RNA binding, anchor, barcode and linker domains but distinct UMI domains that differ from each other in terms of sequence. In such instances, the number of different donor nucleic acids that differ from each other in terms of their UMI domains, and in some instances solely in terms of their UMI domains, employed with a given RNA sample may vary, and in some instances may range from 1,000 to 20,000, such as 5,000 to 10,000.

The donor nucleic acids employed in methods of the invention may be in solution or bound to the surface of a solid phase, as desired. When bound to a surface of a solid phase (i.e., solid support), the donor nucleic acids may be covalently bound or non-covalently bound. The solid phase may vary, where examples of solid phases include, but are not limited to, beads, wells, plates, etc., e.g., made of a suitable solid phase material, such as a polymeric material, where the surface is configured to provide the desired bond to the donor nucleic acids.

In the sample barcoded donor nucleic acids employed in methods of the invention, the order of the different domains may vary. Accordingly, in some embodiments a sample-barcoded donor nucleic acid may have the structure: 3'-linker 1-sample barcode domain-anchor 2 domain-RNA binding domain-5'. In yet other embodiments, the sample-barcoded donor nucleic acid comprises the structure: 3'-RNA binding domain-anchor 1 domain-sample barcode domain-linker 1 domain-5'. These various donor nucleic acids and the protocols in which they find use are further described below.

With respect to donor nucleic acid mediated embodiments, in some instances, additional domains present among a given pair of forward and reverse gene specific primers are a linker and anchor domains. In some instances, the forward gene specific primer includes an anchor domain and the reverse gene specific primer includes a linker domain. In such instances, the forward primers may have the structure 5'-anchor 1-forward gene specific primer (GSP) domain-3' and the reverse primers have the structure: 3'-reverse GSP domain-linker 2-5'. In other instances, the forward gene specific primer includes a linker domain and the reverse gene specific primer includes an anchor domain. In such instances, the forward primers may have the structure: 3'-forward GSP domain-linker 2-5'; and the reverse primers may have the structure 5'-anchor 2-reverse GSP domain-3'.

In some instances, a reverse GSP mediated barcoding protocol is employed. In these embodiments, a sample-specific barcode is ligated to a plurality of different gene-specific primers hybridized to template nucleic acids, e.g., template RNAs, such as template mRNAs, where the GSPs may or may not be extended in a first round primer extension reaction, such as a first round of cDNA synthesis (i.e., a reverse transcription), at the time of ligation. As a result, the reverse GSPs and/or their primer extension, e.g., first strand cDNA, products include a sample-specific barcode domain which originates from the donor nucleic acid. In other words, the sample-specific barcodes are transferred from an initial sample barcoded donor nucleic acids to reverse gene-specific primers that are hybridized to template nucleic acids, such as RNA template molecules, e.g., mRNA. Accordingly, these embodiments may be characterized in that the reverse GSPs are employed in the first strand synthesis step and the sample barcode domain and anchor domain of the donor nucleic acid is ligated to the reverse GSPs such that these domains are incorporated into the first strand synthesis products. A schematic illustration of an embodiment of this protocol is illustrated in FIG. 1.

In the embodiment illustrated in FIG. 1, a sample barcode initially present in a donor nucleic acid is transferred to a reverse GSP during first strand cDNA synthesis from an mRNA template. As shown in FIG. 1, the sample-barcoded donor nucleic acid has the structure: 3'-linker 1-sample barcode domain-anchor 2 domain-RNA binding domain-5'. The 5' end of the donor nucleic acid is bonded to a solid support, and specifically a bead. Also, as illustrated, the reverse GSPs include the structure: 3'-reverse GSP domain-linker 2-5'. In the first step of the protocol illustrated in FIG. 1, the donor nucleic acids and Rev GSPs are combined with the sample ribonucleic acids, e.g., an mRNA sample obtained from a single cell, under hybridization conditions such that the donor nucleic acids bind to the polyA tails of the mRNAs and the GSPs bind to their complementary domains of the mRNAs. Where desired, the resultant mRNA template/GSP/RT Primer complexes may be purified from any excess of unbound gene-specific primers and donor nucleic acids. In the illustrated embodiment shown in FIG. 1, the resultant complexes are immobilized on beads and can be purified from any excess of non-hybridized gene-specific primers using a convenient washing protocol, such as washing protocols known in the art. Alternatively, any excess of unbound oligonucleotides may be removed using other purification protocols, such as but not limited to: nuclease treatment, chromatography, size-dependent binding to specific matrix, e.g. AMPure beads, etc.

Following hybridization of the GSPs and the donor nucleic acids to the mRNAs of the sample, the linker 1 and linker 2 domains of hybridized sample-barcoded donor nucleic acids and GSPs are ligated to produce sample-barcoded reverse primers, e.g., as illustrated in FIG. 1. To provide for sufficient proximity of the ends of the linker domains, a ligation linker may be employed. The ligation linker is an oligonucleotide that includes a first domain complementary to the linker 1 domain of the donor nucleic acid and a second domain complementary to the linker 2 domain of the donor nucleic acid. When employed, the length of the ligated linker may vary, and in some instances ranges 15 to 60 nt, such as 20 to 50 nt, and including 24 to 40 nt. While not required, in some cases the ligation linker domain has a sequence with a GC-content in the range 50% to 80%. The linker 1 and linker 2 domains may be ligated to each other using any convenient DNA ligase, where DNA ligases that may be employed include, but are not limited to: DNA ligases, e.g., Ampligase® Thermostable DNA Ligase, CircLigase-DNA Ligase, E. coli DNA ligase, T3 DNA ligase, T4 DNA ligase, T7 DNA ligase, Taq DNA ligase, and the like.

In the embodiment illustrated in FIG. 1, following ligation to produce sample-barcoded reverse GSPs, the methods include reverse transcribing first strand cDNA molecules from the sample-barcoded reverse primers. Reverse transcription may be accomplished by contacting the template RNA/sample-barcoded reverse GSP complexes with a reverse transcriptase under reverse transcription conditions, e.g., as described in greater detail below. Reverse transcription results in the production of a population of GSP primer extension products having a sample barcode domain and an anchor domain at their 5' ends. Where desired, the donor nucleic acids may include a linker domain at the 3'-end that provides for ligation to the linker of the gene-specific primer but that cannot be extended by a reverse transcriptase, e.g., during the first strand cDNA synthesis step.

Following production of the population GSP primer extension products, e.g., first strand cDNA molecules, as well as any desired purification or enrichment, e.g., to remove unhybridized GSPs, the resultant first strand cDNA molecules may be contacted with a population of forward GSPs, where the forward GSPs have an anchor domain at their 5' ends and a gene-specific domain at their 3' ends. Contact occurs under polymerase mediated primer extension reaction conditions, e.g., as described in further detail below, to produce forward GSP primed primer extension products, e.g., forward GSP primed second strand cDNA molecules. The resultant primer extension products may then be amplified, e.g., using universal primers that bind to the anchor domains, which results in production of a plurality of sample-barcoded anchor-domain-flanked double-stranded gene specific DNA fragments, e.g., as illustrated in FIG. 1. The resultant population of sample-barcoded anchor-domain-flanked double-stranded gene-specific DNA fragments may be further processed, e.g., further amplified, e.g., to add sequencing adaptors, etc., such as described in greater detail below.

In a variation of the protocol illustrated in FIG. 1, the sample barcode domain that is ligated to GSPs is not initially present in a donor nucleic acid that includes a capture domain, such as a RNA binding domain, but instead in a sample barcode donor nucleic acid which lacks a capture, e.g., RNA, binding domain. In such instances the donor nucleic acid may still include an anchor domain positioned 5' of the sample barcode domain. In such instances, the sample barcode donor nucleic acid may be ligated to the GSPs at any convenient time, e.g., following hybridization of the GSPs to the template RNA, prior to GSP hybridization to template RNA, etc.

Figure 2:
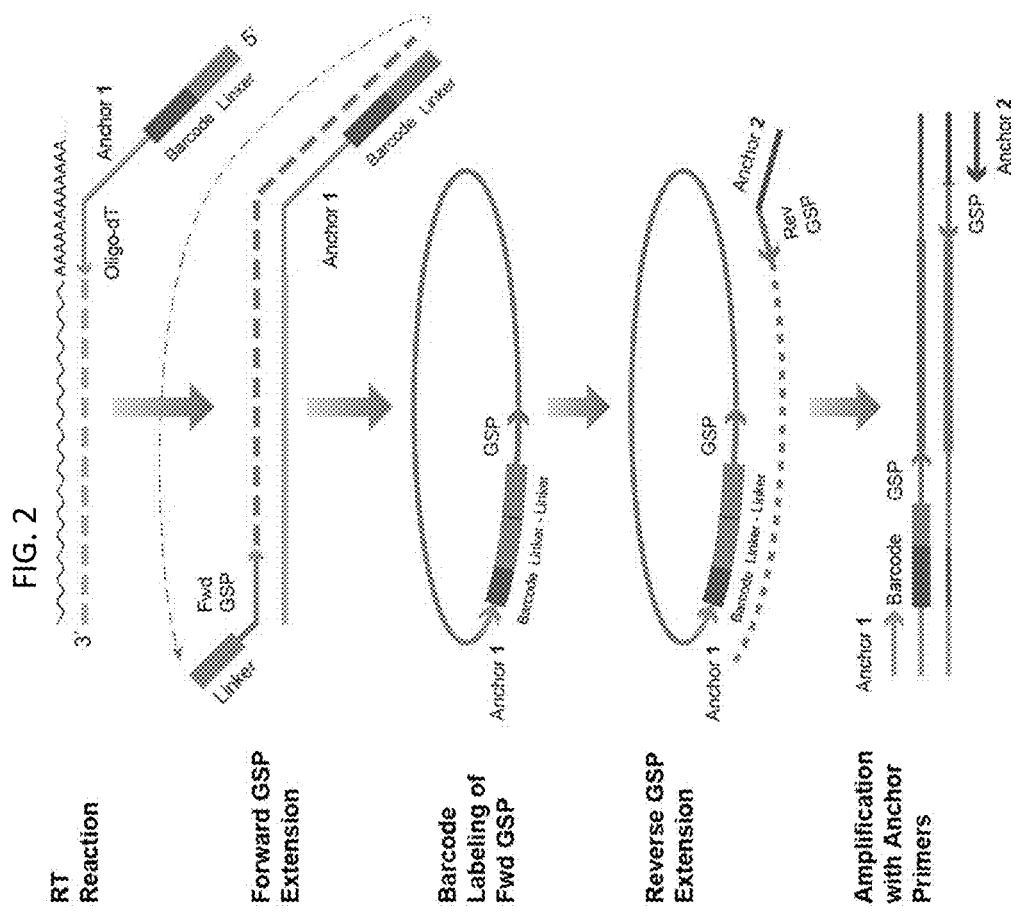
FIG. 2 provides a schematic diagram of a method of preparing a plurality of sample-barcoded anchor-domain-flanked gene specific DNA fragments in accordance with another embodiment of the invention.

In another embodiment where a donor nucleic acid is employed, a circular nucleic acid intermediate molecule is produced to transfer a sample barcode and anchor domain to a gene-specific primer. In examples of this embodiment, a forward GSP primed primer extension product, i.e., forward GSP primed second strand cDNA molecule, is circularized to transfer a sample barcode domain from an initial sample barcoded donor nucleic acid to the forward GSP, e.g., as illustrated in FIG. 2. As shown in the protocol illustrated in FIG. 2, the sample-barcoded donor nucleic acid comprises the structure: 3'-RNA binding domain-anchor 1 domain-sample barcode domain-linker 1 domain-5'. The RNA-binding domain may vary as desired, where examples of such domains include oligo dT domains, random sequence domains, and semi-random sequence domains which may be configured to interact and bind to conservative or common regions in RNA, e.g. polyA, short random sequences (e.g., N6) or short conservative sequences (e.g., nucleotide triplets coding the most abundant amino acids). The anchor 1, sample barcode and linker 1 domains may be as described above. Also, as described above, the donor nucleic acid may include a UMI domain, e.g., linked to the barcode domain, such as described above.

As illustrated in FIG. 2, the donor nucleic acid is employed to prime first strand cDNA synthesis, e.g., by contacting the RNA sample with the sample-barcoded donor nucleic acid under conditions sufficient to reverse transcribe first strand cDNA molecules from the RNA source, e.g., as reviewed in greater detail below. The resultant first strand cDNA molecules (i.e., donor nucleic acid primed primer extension products) are then contacted with a population of forward GSPs, where the forward GSPs include a linker domain and have the structure: 3'-forward GSP domain-linker 2-5'. Contact of the first strand cDNA molecule with the forward GSPs occurs under polymerase mediated primer extension reaction conditions sufficient to produce second strand cDNA molecules comprising a 5' linker 2 domain and a 3' linker 1 domain flanking a forward GSP primed domain, e.g., as illustrated in FIG. 2.

Following forward GSP mediated second strand cDNA synthesis, the flanking linker 1 and linker 2 domains are ligated to produce a circular intermediate, e.g., as illustrated in FIG. 2. To provide for sufficient proximity of the ends of the linker domains, a ligation linker may be employed. As reviewed above, the ligation linker is an oligonucleotide that includes a first domain complementary to the linker 1 domain of the RT primer and a second domain complementary to the linker 2 domain of the donor nucleic acid. When employed, the length of the ligated linker may vary, and in some instances ranges 15 to 60 nt, such as 20 to 50 nt, and including 24 to 40 nt. While not required, in some cases the ligation linker domain has a sequence with a GC-content in the range 50% to 80%. The linker 1 and linker 2 domains may be ligated to each other using any convenient DNA ligase, where DNA ligases that may be employed include, but are not limited to: DNA ligases, e.g., Ampligase® Thermostable DNA Ligase, CircLigase-DNA Ligase, E. coli DNA ligase, T3 DNA ligase, T4 DNA ligase, T7 DNA ligase, Taq DNA ligase, RNA ligase, and the like. As result of this ligation step and consequent circularization of the second strand cDNA molecule, the anchor and sample barcode domains from the initial donor nucleic acid are ligated 5' of the forward GSP. The resultant circularized second strand cDNA molecules are then contacted with the reverse GSPs under primer extension reaction conditions, e.g., as described in greater detail below. The reverse GSPs have the structure: 5'-anchor 2-reverse GSP domain-3' and contact under primer extension reaction conditions produces reverse GSP primed primer extensions products that include an anchor domain at their 5' ends. The resultant primer extension products may then be amplified, e.g., using universal primers that bind to the anchor domains, which results in production of a plurality of sample-barcoded anchor-domain-flanked double-stranded gene specific DNA fragments, e.g., as illustrated in FIG. 2. The resultant population of sample-barcoded anchor-domain-flanked double-stranded gene-specific DNA fragments may be further processed, e.g., further amplified, e.g., to add sequencing adaptors, etc., such as described in greater detail below.

Sample Barcoded GSP Mediated Protocols

As summarized above, embodiments of the methods employ gene specific primers that include a sample barcode domain. Specifically, in such embodiments at least one of the forward or reverse primers of the set of gene specific primers includes a sample barcode domain. In some instances, the reverse gene specific primers of the set, i.e., the reverse gene specific primer subset, include a sample barcode domain. In some instances, the forward gene specific primers of the set, i.e., the forward gene specific primer subset, include a sample barcode domain. Within the a given subset, while the gene specific domain will vary, the sample barcode domain is the same. In some instances, both the forward gene specific primers and the reverse gene specific primers include a barcode domain. In some instances, the barcode domain is 5' of the gene specific domain. In some instances where an anchor domain is also present, the anchor domain is 5' of the sample barcode domain. Other domains such as described above, e.g., UMI domain, etc., may also be present as desired. The length of the selected PCR primers may vary, in some embodiments the reverse barcoded primer is longer than forward primer. Reverse barcoded primer involving in stringent hybridization step with target RNA template composition could have the size in the range between 16 to 120 nt, such as 20 to 80 nt, including 25 to 60 nt, and 30 to 50 nt. Forward gene specific primers in some instances ranges from 16 to 25 nt, such as 18 to 24 nt.

The sample barcode containing gene specific primers employed in these embodiments may be prepared using any convenient protocol, including nucleic acid synthesis protocols, which protocols may or may not include a ligation step, e.g., as described in the working exemplification below. In some embodiments, the sample specific barcodes are attached to set of gene specific primers via a ligation reaction, such as mediated by DNA ligase activity. In ligation reactions, two oligonucleotides are ligated to each other using enzymes having ligation activity, such as DNA-ligases, Circligase, RNA-ligases, etc. The sample-specific barcodes may be ligated directly to the gene-specific primers using single-strand ligases, e.g., Circligase, RNA ligase, etc. In another embodiment, the sample barcodes may be ligated to the gene-specific primers via formation of double-stranded intermediate products and DNA ligases like T4 DNA ligase, Tth DNA ligase, Taq DNA ligase, etc., may be employed. The double-stranded intermediate products may be formed by using oligonucleotides complementary to the 5'-end of gene-specific primers and 3'-end of barcoded oligonucleotides. In order to simplify the ligation reaction composition, specific sequences may be provided at the both 5'-ends and 3'-ends of ligated molecules, e.g., linker domains disclosed in the current application. If both gene-specific primers and barcoded oligonucleotides have linker domains, adding oligonucleotide complementary to both linker domains will form double-stranded intermediates. These double-stranded intermediates with nick between two linker domains may then be ligated by DNA ligase. The linker domains of gene-specific primers may be phosphorylated. The labelling of gene-specific primers with sample-specific barcodes could be performed under gene-specific primer extension conditions, including adding reagents necessary for ligase activity, e.g. NAD, ATP, etc. In another embodiment, the barcode labeling conditions could be different from gene-specific primer extension conditions and use reaction buffer compositions specific for a particular DNA or RNA ligase. If all oligonucleotides are present in solution (e.g., in the wells of microtiter plates), the ligase-mediated barcoding reaction could be easily scaled-up for labeling sets of thousands of gene specific primers with hundreds of different unique sample-specific barcodes (in a separate wells).

Significantly larger scale (up to several millions) sample barcoded primers may be achieved if barcoded oligonucleotides are attached to the bead surface. Synthesis of barcoded oligonucleotides on the bead surface using combinatorial chemistry (pool and split synthesis approach) is well known in art technology and commonly applied for single-cell analysis. For the most single-cell RNA expression profiling assays developed so far, the oligonucleotides with structure: 5'-Anchor-Barcode-oligo dT-3' are synthesized on the beads, wherein the barcode is a combinatorial barcode unique for each bead and the oligo dT domain is a universal sequence used to prime cDNA synthesis from polyA tail of all mRNAs present in biological sample. The current invention uniquely allows the combination of known-in-art combinatorial bead-based barcode synthesis technology with DNA ligation assay for barcode labelling and immobilization of thousands of gene specific primers for each bead. The barcoded gene specific primers immobilized on the beads will be a unique experimental tool for high-throughput single-cell targeted expression profiling of hundreds-thousands of gene targets. As opposed to genome-wide barcode labeling of cDNAs using oligo dT-barcode strategy, the targeted labeling of subset of target transcripts address the main limitation (cost, throughput, quality of data) of current single-cell analysis technologies.

In another pool-split chemical synthesis embodiment, the thousands of gene-specific primers are synthesized on bead surface using conventional phosphoramidite chemistry in the 3'-to-5' direction. Furthermore, all bead-immobilized gene specific primers are mixed together and split for several (e.g., hundreds-thousands) compartments wherein each compartment comprises the same pool of gene specific primers. Each gene specific primer set immobilized on beads in each compartment is used in the next step of barcode synthesis wherein unique sample specific barcode will be synthesized in each compartment. As a result of this pool-split chemical synthesis strategy, the hundreds-thousands of sets of gene specific primers will be encoded with specific barcodes. The barcoded gene specific primer sets could be released from the beads and used in the disclosed primer extension assay.

Figure 3:
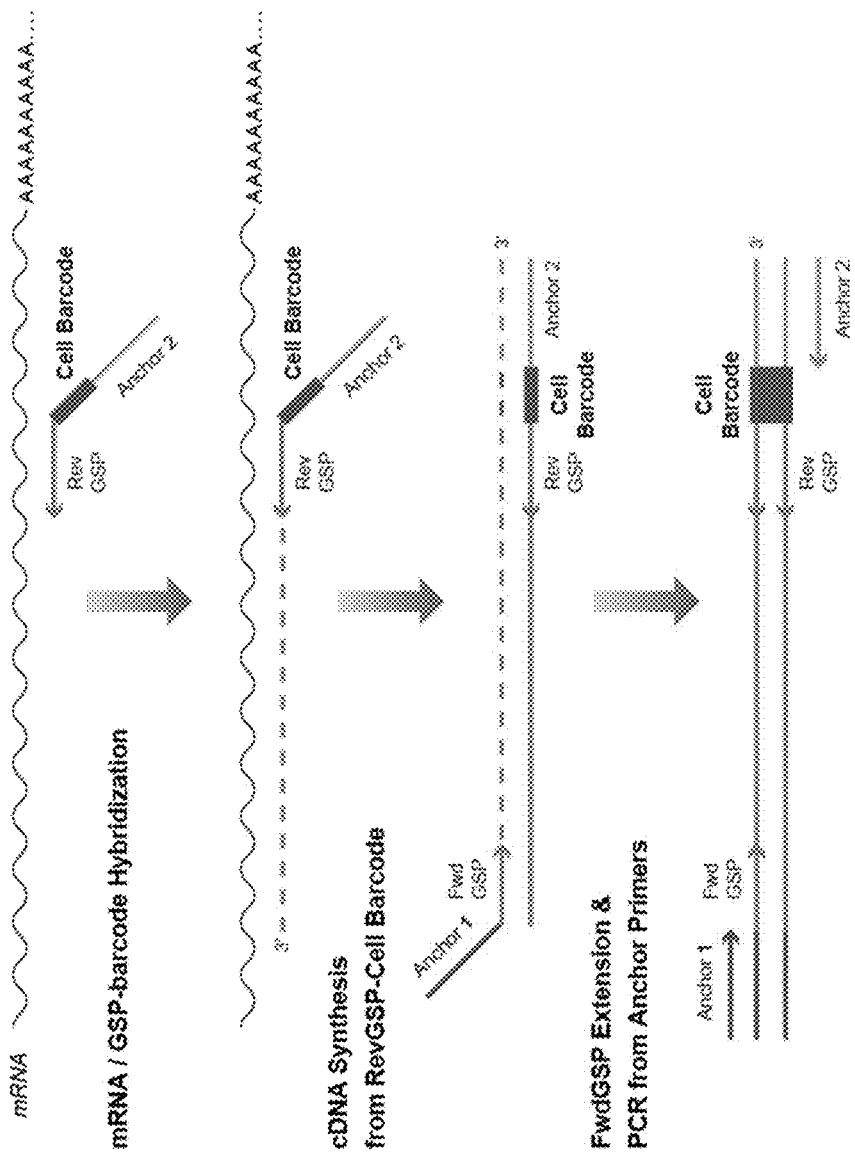
FIG. 3 provides a schematic diagram of a method of preparing a plurality of sample-barcoded anchor-domain-flanked gene specific DNA fragments using reverse primers that include a barcode domain in accordance with an embodiment of the invention.

A schematic illustration of an embodiment a protocol employed sample barcoded reverse gene specific primers is illustrated in FIG. 3. In the embodiment illustrated in FIG. 3, reverse gene specific primers are employed that include a 3' reverse gene specific primer domain (denoted RevGSP), a sample barcode domain (denoted as Cell Barcode) positioned 5' of the gene specific primer domain, and 5' anchor domain (denoted Anchor 2) that is 5' of the sample barcode domain. In the first step of the protocol illustrated in FIG. 3, the reverse gene specific primers are combined with the sample ribonucleic acids, e.g., an mRNA sample obtained from a single cell, under hybridization conditions such that the reverse gene specific primers bind to their complementary domains of the mRNAs. Where desired, the resultant mRNA template/GSP complexes of the resultant hybrid composition may be purified from any excess of unbound gene-specific primers, e.g., using any convenient protocol. For example, any excess of unbound oligonucleotides may be removed using purification protocols, such as but not limited to: nuclease treatment (e.g., exonuclease I treatment), chromatography, size-dependent binding to specific matrix, e.g. AMPure beads, etc.

In the embodiment illustrated in FIG. 3, following hybridization of the sample barcode domain anchor domain comprising reverse gene specific primers to mRNAs of the sample, the methods include reverse transcribing first strand cDNA molecules from the sample-barcoded reverse primers. Reverse transcription may be accomplished by contacting the template RNA/sample-barcoded reverse GSP complexes with a reverse transcriptase under reverse transcription conditions, e.g., as described in greater detail below. Reverse transcription results in the production of a population GSP primer extension products having a sample barcode domain and an anchor domain at their 5' ends.

As illustrated in FIG. 3, following production of the population GSP primer extension products, e.g., first strand cDNA molecules, as well as any desired purification or enrichment, e.g., to remove unhybridized GSPs, the resultant first strand cDNA molecules may be contacted with a population of forward GSPs, where the forward GSPs have an anchor domain at their 5' ends and a gene-specific domain at their 3' ends. Contact occurs under polymerase mediated primer extension reaction conditions, e.g., as described in further detail below, to produce forward GSP primed primer extension products, e.g., forward GSP primed second strand cDNA molecules. Following any desired purification step, e.g., to remove unbound forward GSPs, the resultant primer extension products may then be amplified, e.g., using universal primers that bind to the anchor domains, which results in production of a plurality of sample-barcoded anchor-domain-flanked double-stranded gene specific DNA fragments, e.g., as illustrated in FIG. 3. The resultant population of sample-barcoded anchor-domain-flanked double-stranded gene-specific DNA fragments may be further processed, e.g., further amplified, e.g., to add sequencing adaptors, etc., such as described in greater detail below.

Figure 4:
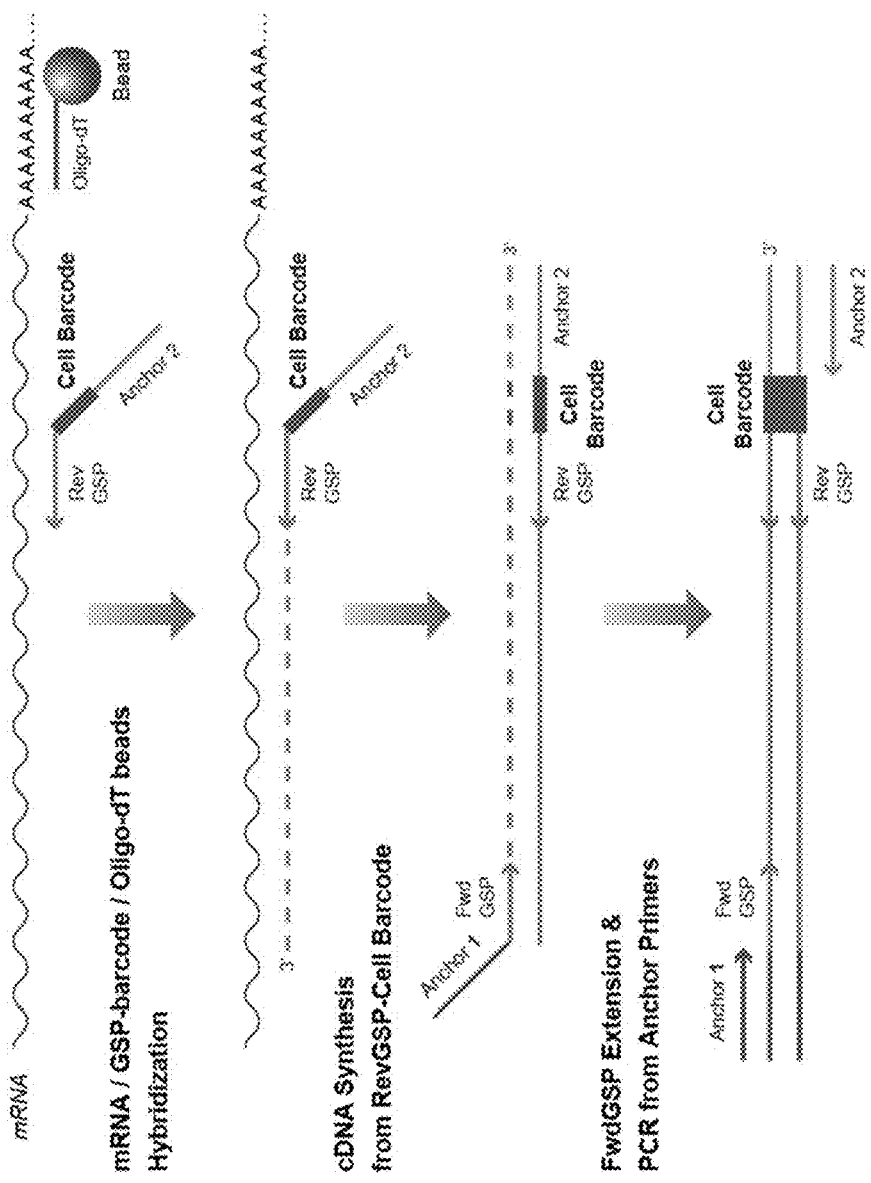
FIG. 4 provides a schematic diagram of a method of preparing a plurality of sample-barcoded anchor-domain-flanked gene specific DNA fragments using bead linked reverse primers that include a barcode domain in accordance with an embodiment of the invention.

In the embodiment illustrated in FIG. 4, reverse gene specific primers as employed in the protocol described for FIG. 3 are employed in conjunction with oligo-dT beads, such as described above. In the first step of the protocol illustrated in FIG. 4, the reverse gene specific primers and oligo-dT beads are combined with the sample ribonucleic acids, e.g., an mRNA sample obtained from a single cell, under hybridization conditions such that the reverse gene specific primers bind to their complementary domains of the mRNAs and the oligo-dT labels of the beads bind to the polyA tails of the mRNAs. Where desired, the resultant mRNA template/GSP/bead complexes of the resultant hybrid composition may be purified from any excess of unbound gene-specific primers, e.g., using any convenient protocol. In the illustrated embodiment shown in FIG. 4, the resultant complexes are immobilized on beads and can be purified from any excess of non-hybridized gene-specific primers using a convenient washing protocol, such as washing protocols known in the art.

In the embodiment illustrated in FIG. 4, following hybridization of the sample barcode domain anchor domain comprises reverse gene specific primers to mRNAs of the sample, the methods include reverse transcribing first strand cDNA molecules from the sample-barcoded reverse primers. Reverse transcription may be accomplished by contacting the template RNA/sample-barcoded reverse GSP complexes with a reverse transcriptase under reverse transcription conditions, e.g., as described in greater detail below. Reverse transcription results in the production of a population GSP primer extension products having a sample barcode domain and an anchor domain at their 5' ends.

As illustrated in FIG. 4, following production of the population GSP primer extension products, e.g., first strand cDNA molecules, as well as any desired purification or enrichment, e.g., to remove unhybridized GSPs, the resultant first strand cDNA molecules may be contacted with a population of forward GSPs, where the forward GSPs have an anchor domain at their 5' ends and a gene-specific domain at their 3' ends. Contact occurs under polymerase mediated primer extension reaction conditions, e.g., as described in further detail below, to produce forward GSP primed primer extension products, e.g., forward GSP primed second strand cDNA molecules. The resultant primer extension products may then be amplified, e.g., using universal primers that bind to the anchor domains, which results in production of a plurality of sample-barcoded anchor-domain-flanked double-stranded gene specific DNA fragments, e.g., as illustrated in FIG. 4. The resultant population of sample-barcoded anchor-domain-flanked double-stranded gene-specific DNA fragments may be further processed, e.g., further amplified, e.g., to add sequencing adaptors, etc., such as described in greater detail below.

In some instances, the sample barcoded reverse primers are linked to a solid support. The solid support may vary, where examples of solid supports include beads, wells, plates, etc., e.g., made of a suitable solid phase material, such as a polymeric material, where the surface is configured to provide the desired bond to the reverse primers. In some instances, the reverse gene specific primer is linked to the solid support by a cleavable linker, i.e., a linker that may be broken in response to an applied stimulus. In such instances, any convenient cleavable linker may be employed. Examples of cleavable linkers that may be employed include, but are not limited to, thermal-labile linkers, enzymatically-labile linkers, light-labile linkers, etc.

In some instances, the linker is a thermal labile linker that includes a thermally-labile blocking moiety. A thermally-labile blocking moiety is a moiety that may be cleaved when the temperature of the primer is raised above a certain threshold value. While the threshold value may vary, in some instances the threshold value is 60° C. or higher, such as 75° C. or higher, including 90° C. or higher. Examples of thermally labile moieties that may be employed in accordance with the invention include, but are not limited to, those described in U.S. Pat. Nos. 8,133,669 and 8,361,753; the disclosures of which are herein incorporated by reference. In some instances, the thermally labile blocking moiety is a 3' blocking moiety, such as but not limited to: O-phenoxyacetyl; O-methoxyacetyl; O-acetyl; O-(p-toluene)sulfonate; O-phosphate; O-nitrate; O[4-methoxy]-tetrahydrothiopyranyl; O-tetrahydrothiopyranyl; O-[5-methyl]-tetrahydrofuranyl; O[2-methyl,4-methoxy]-tetrahydropyranyl; O-[5-methyl]-tetrahydropyranyl; and O-tetrahydrothiofuranyl.

In some instances, the linker is an enzymatically-labile linker. An enzymatically-labile linker includes a moiety that may be cleaved by exposing the linker to a suitable enzyme that cleaves the moiety. Examples of enzymatically-labile moieties of interest include those having a linkage group cleavable by a hydrolase enzyme. Examples of hydrolase enzymes of interest include, but are not limited to: esterases, phosphatases, peptidases, penicillin amidases, glycosidases and phosphorylases, kinases, etc. Hydrolase susceptible linkages and hydrolase enzymes are further described in U.S. Patent Application Publication No. 20050164182 and U.S. Pat. No. 7,078,499; the disclosures of which are herein incorporated by reference.

In some instances, the linker is a chemically-labile linker that includes a chemically-labile moiety. A chemically-labile is a moiety that may be cleaved by exposing the linker to a chemical agent that cleaves the moiety. The chemically-labile moiety may be reactive with the functional group of a chemical agent (e.g., an azido-containing modifiable group that is reactive with an alkynyl-containing reagent or a phosphine reagent, or vice versa, or a disulfide that is reactive with a reducing agent such as tris(2-carboxyethyl) phosphine (TCEP) or DTT). A variety of functional group chemistries and chemical agent stimuli suitable for modifying them may be utilized in the subject methods. Functional group chemistries and chemical agents of interest include, but are not limited to, click chemistry groups and reagents (e.g., as described by Sharpless et al., (2001), "Click Chemistry: Diverse Chemical Function from a Few Good Reactions", Angewandte Chemie International Edition 40 (11): 2004-2021), Staudinger ligation groups and reagents (e.g., as described by Bertozzi et al., (2000), "Cell Surface Engineering by a Modified Staudinger Reaction", Science 287 (5460): 2007), and other bioconjugation groups and reagents (e.g., as described by Hermanson, Bioconjugate Techniques, Second Edition, Academic Press, 2008). In certain embodiments, the chemically-labile blocking moiety includes a functional group selected from an azido, a phosphine (e.g., a triaryl phosphine or a trialkyl phosphine or mixtures thereof), a dithiol, an active ester, an alkynyl, a protected amino, a protected hydroxy, a protected thiol, a hydrazine, and a disulfide.

In some instances, the cleavable linker is a light-labile linker that includes a light-labile moiety, which is a moiety that may be cleaved by exposing the linker to light at a wavelength that cleaves the moiety from the linker. Examples of light-labile moieties of interest include cleavable by light of a certain wavelength that cleaves a photocleavable group in the linkage group. Any convenient photocleavable groups may find use. Cleavable groups and linkers may include photocleavable groups comprising covalent bonds that break upon exposure to light of a certain wavelength. Suitable photocleavable groups and linkers for use in the subject MCIPs include ortho-nitrobenzyl-based linkers, phenacyl linkers, alkoxybenzoin linkers, chromium arene complex linkers, NpSSMpact linkers and pivaloylglycol linkers, as described in Guillier et al. (Chem. Rev. 2000 1000:2091-2157). For example, a 1-(2-nitrophenyl)ethyl-based photocleavable linker (Ambergen) can be efficiently cleaved using near-UV light, e.g., achieving>90% yield in 5-10 minutes using a 365 nm peak lamp at 1-5 mW/cm2. In some embodiments, the modifiable group is a photocleavable group such as a nitro-aryl group, e.g., a nitro-indole group or a nitro-benzyl group, including but not limited to: 2-nitroveratryloxycarbonyl, α-carboxy-2-nitrobenzyl, 1-(2-nitrophenyl)ethyl, 1-(4,5-dimethoxy-2-nitrophenyl)ethyl and 5-carboxymethoxy-2-nitrobenzyl. Nitro-indole groups of interest include, e.g., a 3-nitro-indole, a 4-nitro indole, a 5-nitro indole, a 6-nitro-indole or a 7-nitro-indole group, where the indole ring may be further substituted at any suitable position, e.g., with a methyl group or a halo group (e.g., a bromo or chloro), e.g., at the 3-, 5- or 7-position. In certain embodiments, the nitro-aryl group is a 7-nitro indolyl group. In certain instances, the 7-nitro indolyl group is further substituted with a substituent that increases the photoactivity of the group, e.g., substituted with a bromo at the 5-position. Any convenient photochemistry of nitroaryl groups may be adapted for use. In certain embodiments, the linker includes a photocleavable group, such as a nitro-benzyl protecting group or a nitro-indolyl group.

Figure 5:
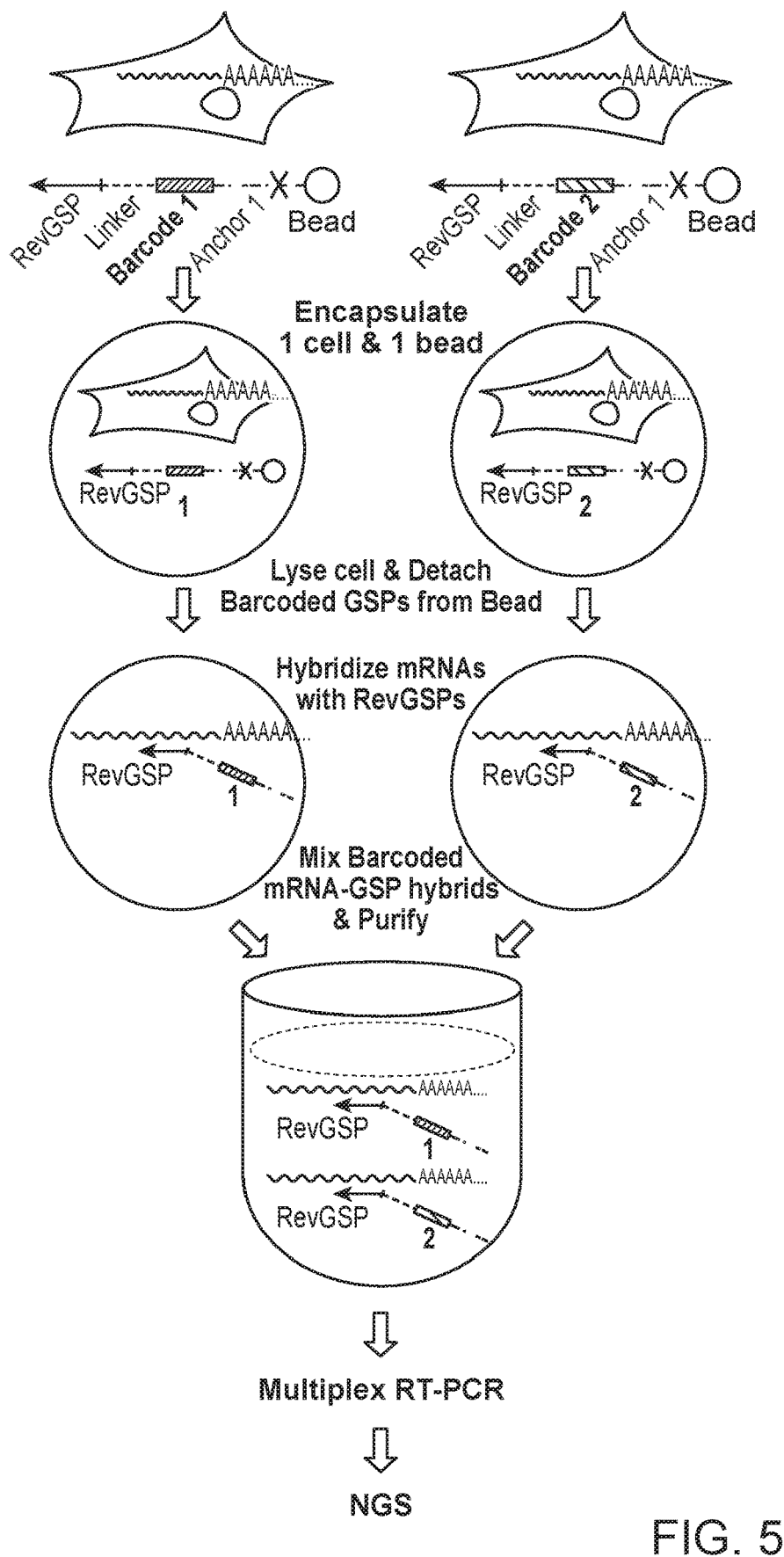
FIG. 5 provides a schematic diagram of a method of preparing a plurality of sample-barcoded anchor-domain-flanked gene specific DNA fragments using bead linked sample barcode domain comprising reverse primers in a droplet mediated protocol in accordance with an embodiment of the invention.

An example of a protocol that employs sample barcoded reverse gene specific primers linked to a solid support by a cleavable linker is illustrated in FIG. 5. In the protocol illustrated in FIG. 5, template ribonucleic acids from two cells are employed, where the protocol employs a pooling step and sample barcodes to match the results to the cellular source. As illustrated in FIG. 5, reverse gene specific primers are employed that include a 3' reverse gene specific primer domain (denoted RevGSP), a non-cleavable linker domain (denoted Linker) that is 5' of the RevGSP, a sample barcode domain (denoted as Barcode 1 or Barcode 2) positioned 5' of the non-cleavable linker, a 5' anchor domain (denoted Anchor 1) that is 5' of the sample barcode domain, and a bead linked to the 5' end of the Anchor 1 domain by a cleavable linker (shown as an X).

In the first step of the protocol illustrated in FIG. 5, the sample barcoded reverse gene specific primers that include the Barcode 1 sample barcode are combined with a first cell and encapsulated in a first droplet, e.g., as described below. The sample barcoded reverse gene specific primers that include the Barcode 2 sample barcode are combined with a second cell and encapsulated in a second droplet. The cells in the first and second droplets are then lysed and the beads are removed from the reverse primers by cleaving the cleavable linker. In each of the first and second droplets, the resultant cleaved reverse primers are maintained with the liberated mRNAs obtained from the lysed cells under hybridization conditions such that the reverse gene specific primers bind to their complementary domains of the mRNAs.

As illustrated in FIG. 5, the first and second droplets containing the resultant hybrid composition of the mRNA template/GSP complexes are then combined or pooled into a single composition. Following this pooling step, excess unbound gene-specific primers are removed from the combined composition so that the combined hybrid compositions can be purified from any excess of unbound gene-specific primers, e.g., using any convenient protocol. For example, any excess of unbound oligonucleotides may be removed using purification protocols, such as but not limited to: nuclease treatment (e.g., exonuclease I treatment), chromatography, size-dependent binding to specific matrix, e.g. AMPure beads, etc.

In the embodiment illustrated in FIG. 5, following purification, the methods include reverse transcribing first strand cDNA molecules from the sample-barcoded reverse primers. As reviewed above, reverse transcription may be accomplished by contacting the template RNA/sample-barcoded reverse GSP complexes with a reverse transcriptase under reverse transcription conditions, e.g., as described in greater detail below. Reverse transcription results in the production of a population GSP primer extension products having a sample barcode domain and an anchor domain at their 5' ends.

Following production of the population GSP primer extension products, e.g., first strand cDNA molecules, as well as any desired purification or enrichment, e.g., to remove unhybridized GSPs, the resultant first strand cDNA molecules may be contacted with a population of forward GSPs, where the forward GSPs have an anchor domain at their 5' ends and a gene-specific domain at their 3' ends. Contact occurs under polymerase mediated primer extension reaction conditions, e.g., as described in further detail below, to produce forward GSP primed primer extension products, e.g., forward GSP primed second strand cDNA molecules. Following any desired purification, e.g., to remove unbound forward GSPs, the resultant primer extension products may then be amplified, e.g., using universal primers that bind to the anchor domains, which results in production of a plurality of sample-barcoded anchor-domain-flanked double-stranded gene specific DNA fragments. The resultant population of sample-barcoded anchor-domain-flanked double-stranded gene-specific DNA fragments may be further processed, e.g., further amplified, e.g., to add sequencing adaptors, etc., such as described in greater detail below, e.g., for performing NGS.

In some instances where the sample barcoded reverse primers are bound to a solid support, such as a bead, by a cleavable linker (e.g., as described above), the solid support may further include a specific binding pair member, e.g., that includes a specific binding domain that specifically binds to a marker of a cell of interest. Specific binding domains of interest include, but are not limited to, antibody binding agents, proteins, peptides, haptens, nucleic acids, etc. The term "antibody binding agent" as used herein includes polyclonal or monoclonal antibodies or fragments that are sufficient to bind to an analyte of interest. The antibody fragments can be, for example, monomeric Fab fragments, monomeric Fab' fragments, or dimeric F(ab)'2 fragments. Also within the scope of the term "antibody binding agent" are molecules produced by antibody engineering, such as single-chain antibody molecules (scFv) or humanized or chimeric antibodies produced from monoclonal antibodies by replacement of the constant regions of the heavy and light chains to produce chimeric antibodies or replacement of both the constant regions and the framework portions of the variable regions to produce humanized antibodies. The marker of the cell of interest may be any convenient marker, such as a cell surface protein or structure having an epitope to which the specific binding domain may specifically bind. In such instances, the bead linked sample barcoded reverse primers may include one or more additional domains of interest, such as bead identifying domains (bead barcodes), antibody identifying domains (antibody barcodes), etc.

Figure 6:
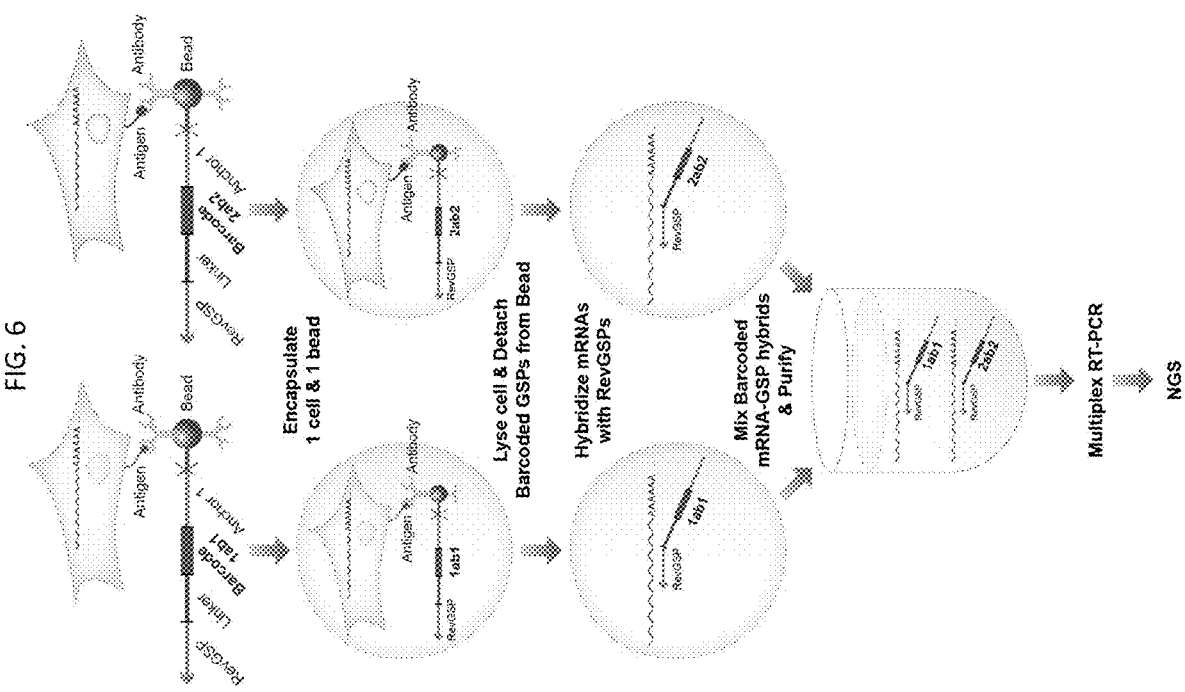
FIG. 6 provides a schematic diagram of a method of preparing a plurality of sample-barcoded anchor-domain-flanked gene specific deoxyribonucleic acid (DNA) fragments using specific binding member bead linked sample barcode domain comprising reverse primers in a droplet mediated protocol in accordance with an embodiment of the invention.

An example of a protocol that employs sample barcoded reverse gene specific primers linked to a solid support by a cleavable linker, where the support includes a cell specific binding domain, is illustrated in FIG. 6. In the protocol illustrated in FIG. 6, template ribonucleic acids from two cells are employed, where the protocol employs a pooling step and sample barcodes are employed to match the results to the cellular source and antibody employed. As illustrated in FIG. 6, reverse gene specific primers are employed that include a 3' reverse gene specific primer domain (denoted RevGSP), a non-cleavable linker domain (denoted Linker) that is 5' of the RevGSP, a sample barcode domain (denoted as Barcode 1 or Barcode 2) positioned 5' of the non-cleavable linker, an antibody barcode domain (denoted ab1 or ab2) positioned 5' of the sample barcode domain, a 5' anchor domain (denoted Anchor 1) that is 5' of the sample barcode domain, a bead linked to the 5' end of the Anchor 1 domain by a cleavable linker (shown as an X) and an antibody on the bead that specifically binds to a cell surface antigen.

In the first step of the protocol illustrated in FIG. 6, the sample barcoded reverse gene specific primers that include the Barcode 1 sample barcode and ab1 barcode (collectively denoted 1ab1) are combined with a first cell under conditions sufficient for the antibody on the bead to specifically bind to the antigen on the cell, and the resultant binding complex is encapsulated in a first droplet. The sample barcoded reverse gene specific primers that include the Barcode 2 sample barcode and ab2 barcode (collectively denoted 2ab2) are combined with a second cell under conditions sufficient for the antibody on the bead to specifically bind to the antigen on the cell, and the resultant binding complex is encapsulated in a second droplet. The cells in the first and second droplets are then lysed and the beads are removed from the reverse primers by cleaving the cleavable linker. In each of the first and second droplets, the resultant cleaved reverse primers are maintained with the liberated mRNAs obtained from the lysed cells under hybridization conditions such that the reverse gene specific primers bind to their complementary domains of the mRNAs.

As illustrated in FIG. 6, the first and second droplets containing the resultant hybrid composition of the mRNA template/GSP complexes are then combined or pooled into a single composition. Following this pooling step, excess unbound gene-specific primers are removed from the combined composition so that the combined hybrid compositions can be purified from any excess of unbound gene-specific primers, e.g., using any convenient protocol. For example, any excess of unbound oligonucleotides may be removed using purification protocols, such as but not limited to: nuclease treatment (e.g., exonuclease I treatment), chromatography, size-dependent binding to specific matrix, e.g. AMPure beads, etc.

In the embodiment illustrated in FIG. 6, following purification, the methods include reverse transcribing first strand cDNA molecules from the sample-barcoded reverse primers. As reviewed above, reverse transcription may be accomplished by contacting the template RNA/sample-barcoded reverse GSP complexes with a reverse transcriptase under reverse transcription conditions, e.g., as described in greater detail below. Reverse transcription results in the production of a population GSP primer extension products having a sample barcode domain and an anchor domain at their 5' ends.

Following production of the population GSP primer extension products, e.g., first strand cDNA molecules, as well as any desired purification or enrichment, e.g., to remove unhybridized GSPs, the resultant first strand cDNA molecules may be contacted with a population of forward GSPs, where the forward GSPs have an anchor domain at their 5' ends and a gene-specific domain at their 3' ends. Contact occurs under polymerase mediated primer extension reaction conditions, e.g., as described in further detail below, to produce forward GSP primed primer extension products, e.g., forward GSP primed second strand cDNA molecules. Following any desired purification, e.g., to remove unbound forward GSPs, the resultant primer extension products may then be amplified, e.g., using universal primers that bind to the anchor domains, which results in production of a plurality of sample-barcoded anchor-domain-flanked double-stranded gene specific DNA fragments. The resultant population of sample-barcoded anchor-domain-flanked double-stranded gene-specific DNA fragments may be further processed, e.g., further amplified, e.g., to add sequencing adaptors, etc., such as described in greater detail below, e.g., for performing NGS.

Template Nucleic Acids

Components of the subject reaction mixtures may include one or more template nucleic acids. Such template nucleic acids provide the template from which template nucleic acid-mediated primer extension reactions and other nucleic acid production reactions may be performed. Nucleic acid templates may be added to a reaction mixture, e.g., through direct addition of the nucleic acid template, through lysing one or more cells containing the nucleic acid template, and the like, or one or more nucleic acid templates may be generated during the reaction, e.g., as an intermediate product of a prior nucleic acid production reaction. Essentially any nucleic acid template may find use in the subject methods, including e.g., RNA template nucleic acid and DNA template nucleic acids. RNA template nucleic acids may vary and may include e.g., messenger RNA (mRNA) templates, and the like. In addition, various types of DNA templates may be employed, including but not limited to e.g., genomic DNA templates, mtDNA templates, synthetic DNA templates, etc.

According to certain embodiments, the template nucleic acids are template ribonucleic acids (template RNA). Template RNAs may be any type of RNA (or sub-type thereof) including, but not limited to, a messenger RNA (mRNA), a microRNA (miRNA), a small interfering RNA (siRNA), a transacting small interfering RNA (ta-siRNA), a natural small interfering RNA (nat-siRNA), a ribosomal RNA (rRNA), a transfer RNA (tRNA), a small nucleolar RNA (snoRNA), a small nuclear RNA (snRNA), a long non-coding RNA (lncRNA), a non-coding RNA (ncRNA), a transfer-messenger RNA (tmRNA), a precursor messenger RNA (pre-mRNA), a small Cajal body-specific RNA (scaRNA), a piwi-interacting RNA (piRNA), an endoribonuclease-prepared siRNA (esiRNA), a small temporal RNA (stRNA), a signal recognition RNA, a telomere RNA, a ribozyme, or any combination of RNA types thereof or subtypes thereof.

According to certain embodiments, the template nucleic acids are template deoxyribonucleic acids (template DNA). A template DNA may be any type of DNA of interest to a practitioner of the subject methods, including but not limited to genomic DNA or fragments thereof, complementary DNA (or "cDNA", synthesized from any RNA or DNA of interest), recombinant DNA (e.g., plasmid DNA), or the like.

The number of distinct template nucleic acids of differing sequence in a given template nucleic acid composition may vary. While the number of distinct template nucleic acids in a given template nucleic acid composition may vary, in some instances the number of distinct template nucleic acids in a given template nucleic acid composition ranges from 1 to $10^8$, such as 1 to $10^7$, including 1 to $10^5$.

The template nucleic acid composition employed in such methods may be any suitable nucleic acid sample. The nucleic acid sample that includes the template nucleic acid may be combined into the reaction mixture in an amount sufficient for producing the product nucleic acid. According to one embodiment, the nucleic acid sample is combined into the reaction mixture such that the final concentration of nucleic acid in the reaction mixture is from 1 fg/μL to 10 μg/μL, such as from 1 μg/μL to 5 μg/μL, such as from 0.001 μg/μL to 2.5 μg/μL, such as from 0.005 μg/μL to 1 μg/μL, such as from 0.01 μg/μL to 0.5 μg/μL, including from 0.1 μg/μL to 0.25 μg/μL.

Template nucleic acid components are nucleic acid samples that contain one or more types of template nucleic acids, as described in more detail below. Template nucleic acid components may be derived from cellular samples including cellular samples that contain a single cell or a population of cells containing, e.g., two or more cells. Cellular samples may be derived from a variety of sources including but not limited to e.g., a cellular tissue, a biopsy, a blood sample, a cell culture, etc. Additionally, cellular samples may be derived from specific organs, tissues, tumors, neoplasms, or the like. Furthermore, cells from any population can be the source of a cellular sample used in the subject methods, such as a population of prokaryotic or eukaryotic single celled organisms including bacteria or yeast.

As such, in some instances, the source of an RNA sample utilized in the subject methods may be a mammalian cellular sample, such as a rodent (e.g., mouse or rat) cellular sample, a non-human primate cellular sample, a human cellular sample, or the like. In some instances, a mammalian cellular sample may be mammalian blood sample, including but not limited to e.g., a rodent (e.g., mouse or rat) blood sample, a non-human primate blood sample, a human blood sample, or the like.

In some instances, the template nucleic acid component is from a single cell. A template nucleic acid component from a single cell is a nucleic acid composition, e.g., a composition of one or more distinct nucleic acids, such as ribonucleic acids or deoxyribonucleic acids that originate or are derived from a single cell. As used herein, a "single cell" refers to one cell. Single cells useful as the source of template nucleic acids, e.g., RNAs or DNAs, can be obtained from an organism or tissue of interest, or from a biopsy, blood sample, or cell culture, etc. Additionally, cells from specific organs, tissues, tumors, neoplasms, or the like can be obtained and used in the methods described herein. In some instances, the template nucleic acid component is obtained from a portion of a single cell. Single cell portions of interest include, but are not limited to: organelles, exosomes or more broadly nucleic acids contained within, or associated with, a protein and or lipid bearing membrane.

Template nucleic acids of template nucleic acid components employed in embodiments of the invention may contain a plurality of distinct template nucleic acids of differing sequence. Template nucleic acids (e.g., a template RNA, a template DNA, or the like) may be polymers of any length. While the length of the polymers may vary, in some instances the polymers are 10 nt or longer, 20 nt or longer, 50 nt or longer, 100 nt or longer, 500 nt or longer, 1000 nt or longer, 2000 nt or longer, 3000 nt or longer, 4000 nt or longer, 5000 nt or longer or more nt. In certain aspects, template nucleic acids are polymers, where the number of bases on a polymer may vary, and in some instances is 10 nt or less, 20 nt or less, 50 nt or less, 100 nt or less, 500 nt or less, 1000 nt or less, 2000 nt or less, 3000 nt or less, 4000 nt or less, or 5000 nt or less, 10,000 nt or less, 25,000 nt or less, 50,000 nt or less, 75,000 nt or less, 100,000 nt or less.

Single cells, for use in the herein described methods relating thereto, may be obtained by any convenient method. For example, in some instances, single cells may be obtained through limiting dilution of cellular sample. In some instances, the present methods may include a step of obtaining single cells. A single cell suspension can be obtained using standard methods known in the art including, for example, enzymatically using trypsin or papain to digest proteins connecting cells in tissue samples or releasing adherent cells in culture, or mechanically separating cells in a sample. Single cells can be placed in any suitable reaction vessel in which single cells can be treated individually. For example, a 96-well plate, 384 well plate, or a plate with any number of wells such as 2000, 4000, 6000, or 10000 or more. The multi-well plate can be part of a chip and/or device. The present disclosure is not limited by the number of wells in the multi-well plate. In various embodiments, the total number of wells on the plate is from 100 to 200,000, or from 5000 to 10,000. In other embodiments the plate comprises smaller chips, each of which includes 5,000 to 20,000 wells. For example, a square chip may include 125 by 125 nanowells, with a diameter of 0.1 mm. Such methods are further described in greater detail below.

In some instances, single cells may be obtained by sorting a cellular sample using a cell sorter instrument. By "cell sorter" as used herein is meant any instrument that allows for the sorting of individual cells into an appropriate vessel for downstream processes, such as those processes of library preparation as described herein. Useful cell sorters include flow cytometers, such as those instruments utilized in fluorescence activated cell sorting (FACS). Flow cytometry is a well-known methodology using multi-parameter data for identifying and distinguishing between different particle (e.g., cell) types i.e., particles that vary from one another terms of label (wavelength, intensity), size, etc., in a fluid medium. In flow cytometrically analyzing a sample, an aliquot of the sample is first introduced into the flow path of the flow cytometer. When in the flow path, the cells in the sample are passed substantially one at a time through one or more sensing regions, where each of the cells is exposed separately individually to a source of light at a single wavelength (or in some instances two or more distinct sources of light) and measurements of scatter and/or fluorescent parameters, as desired, are separately recorded for each cell. The data recorded for each cell is analyzed in real time or stored in a data storage and analysis means, such as a computer, for later analysis, as desired.

Cells sorted using a flow cytometer may be sorted into a common vessel (i.e., a single tube), or may be separately sorted into individual vessels. For example, in some instances, cells may be sorted into individual wells of a multi-well plate, as described below.

Useful cell sorters also include multi-well-based systems that do not employ flow cytometry. Such multi-well based systems include essentially any system where cells may be deposited into individual wells of a multi-well container by any convenient means, including e.g., through the use of Poisson distribution (i.e., limiting dilution) statistics, individual placement of cells (e.g., through manual cell picking or dispensing using a robotic arm or pipettor). In some instances, useful multi-well systems include a multi-well wafer or chip, where cells are deposited into the wells or the wafer/chip and individually identified by a microscopic analysis system. In some instances, an automated microscopic analysis system may be employed in conjunction with a multi-well wafer/chip to automatically identify individual cells to be subjected to downstream analyses, including library preparation, as described herein.

In some instances, one or more cells may be sorted into or otherwise transferred to an appropriate reaction vessel. Reaction components may be added to reaction vessels, including e.g., components for preparing a template nucleic acid component, components for generating a product double stranded cDNA, components for one or more library preparation reactions, etc.

The wells of a multi-well device can be designed such that a single well includes a single cell or a single droplet. An individual cell or droplet may also be isolated in any other suitable container, e.g., microfluidic chamber, droplet, nanowell, tube, etc. Any convenient method for manipulating single cells or droplets may be employed, where such methods include fluorescence activated cell sorting (FACS), robotic device injection, gravity flow, or micromanipulation and the use of semi-automated cell pickers (e.g. the Quixell™ cell transfer system from Stoelting Co.), etc. In some instances, single cells or droplets can be deposited in wells of a plate according to Poisson statistics (e.g., such that approximately 10%, 20%, 30% or 40% or more of the wells contain a single cell or droplet—which number can be defined by adjusting the number of cells or droplets in a given unit volume of fluid that is to be dispensed into the containers). In some instances, a suitable reaction vessel comprises a droplet (e.g., a microdroplet). Individual cells or droplets can, for example, be individually selected based on features detectable by microscopic observation, such as location, morphology, the presence of a reporter gene (e.g., expression), the presence of a bound antibody (e.g., antibody labelling), FISH, the presence of an RNA (e.g., intracellular RNA labelling), or qPCR.

Following obtainment of a desired cell population or single cells, e.g., as described above, nucleic acids can be released from the cells by lysing the cells. Lysis can be achieved by, for example, heating or freeze-thaw of the cells, or by the use of detergents or other chemical methods, or by a combination of these. However, any suitable lysis method can be used. In some instances, a mild lysis procedure can advantageously be used to prevent the release of nuclear chromatin, thereby avoiding genomic contamination of a cDNA library, and to minimize degradation of mRNA. For example, heating the cells at 72° C. for 2 minutes in the presence of Tween-20 is sufficient to lyse the cells while resulting in no detectable genomic contamination from nuclear chromatin. Alternatively, cells can be heated to 65° C. for 10 minutes in water (Esumi et al., Neurosci Res 60(4):439-51 (2008)); or 70° C. for 90 seconds in PCR buffer II (Applied Biosystems) supplemented with 0.5% NP-40 (Kurimoto et al., Nucleic Acids Res 34(5):e42 (2006)); or lysis can be achieved with a protease such as Proteinase K or by the use of chaotropic salts such as guanidine isothiocyanate (U.S. Publication No. 2007/0281313).

Calibration Control Template Composition

In some instances, preparation of the target nucleic acid template composition includes combining an initial nucleic acid composition, e.g., as described above, with a calibration control template composition, e.g., to produce a target nucleic acid template composition that is spiked with a control template mixture, which mixture may be made up of synthetic nucleic acids, naturally occurring nucleic acids or a combination thereof. As to structural requirements, the calibration control template nucleic acids at least include an amplicon structure with two primer binding sites which mimic natural target template nucleic acid. In some embodiments, the control template mix is a synthetic control template mix that includes calibration control template nucleic acids having sequences that mimic, but are different from, the sequences of target template nucleic acids. For example, a calibration control template nucleic acid could have one, two, or more point mutations downstream of primer binding sites. These mutations may be identified by downstream NGS analysis allowing one to uniquely identify and differentiate sample specific and control template nucleic acids from each other. Other types of control template modifications (e.g., deletions, insertions, etc.) could be employed, as desired. Furthermore, the calibration control templates may mimic natural target nucleic acid template structures. For example, synthetic gene or gene fragments with several point mutations could be synthesized under the control of a T7 promoter, and T7 transcripts which mimic the natural template target mRNA sequences and structures could be synthesized in vitro and spiked to into a cell extract or purified RNA at any known concentration. Moreover, the set of calibration standards designed against the same target mRNA with different mutations could be spiked into target template compositions at different amounts (e.g. at 1, 10, 100, 1000 copies per cell). The spiked calibration controls could be employed as internal calibration standards in primer extension assays which allow one to calculate the actual concentration of natural target mRNA template. Moreover, the spiked calibration standards may be employed as universal standards to do quality control of target mRNAs in biological samples. For example, if cells are apoptotic, non-functional or damaged, the calibration standards spiked into a single-cell analysis would allow one to reveal these defect cells with degraded or missing template RNAs. The calibration control nucleic acid templates could be spiked directly into a cell, cell extract, cell fractions, purified cells or at any step of the primer extension and multiplex PCR protocol. In one embodiment, the control nucleic acid templates are spiked into cells, cell extracts or purified RNA. For example, in single-cell analysis, the control RNA templates could be mixed with lysis/hybridization buffer prior to droplet formation in 10× Genomics, Mission Bio or BioRad single-cell analysis platforms. In other embodiments, the control template compositions could be spiked into cell lysates by pipet (e.g., ink-jet printer) or immobilized on beads together with barcoded gene specific primers. Calibration control templates could be designed and developed for single gene or gene sets including genome-wide set. For example, a mix of calibration control RNAs could be developed for a set of housekeeping genes. The housekeeping calibration control RNAs would allow one to compare the content and quality of target template RNAs in the single-cells or multiplex analysis of plurality of clinical samples. The set of cell specific marker calibration control RNAs may allow one to perform QC and identify specific cell types. Genome-wide set of calibration control RNAs could be employed to perform quantitative analysis of expression of all genes in any cell or biological sample. In another embodiment, the calibration control RNAs designed against pathogens (e.g. viruses, bacterial species, etc.) may be employed as a unique tool to perform quantitative expression analysis of pathogenic genes in the background of human transcripts in clinical samples. Calibration control templates as internal calibration standards are unique tool for analysis plurality of biological samples in parallel. Combination of barcoded gene specific primers and calibration control nucleic acid templates allows one to combine samples together at the early stage of the protocol and perform powerful multiplex analysis of hundreds of samples or thousands of single cells in parallel in single test tube.

Primer Extension Reaction Conditions

As reviewed above, aspects of the methods include contacting primers, e.g., oligo dT primers and/or GSPs, such as described above, with a nucleic acid template composition, which may be made up of an initial nucleic acid sample or be primer extension products, under primer extension reaction conditions. By "primer extension reaction conditions" is meant reaction conditions that permit polymerase-mediated extension of a 3' end of a nucleic acid strand, i.e., primer, hybridized to a template nucleic acid. Achieving suitable reaction conditions may include selecting reaction mixture components, concentrations thereof, and a reaction temperature to create an environment in which the polymerase is active and the relevant nucleic acids in the reaction interact (e.g., hybridize) with one another in the desired manner.

The concentration of primers in the primer extension reaction mixture produced upon combination of the template nucleic acid and primers may vary, as desired. The amount of target template nucleic acid that is combined with the primers and other reagents, e.g., as described below, to produce a primer extension reaction mixture may vary. In some instances, the target nucleic acid template composition is combined into the reaction mixture such that the final concentration of nucleic acid in the reaction mixture ranges from 1 fg/µL to 10 µg/µL, such as from 1 µg/µL to 5 µg/µL, such as from 0.1 ng/µL to 50 ng/µL, such as from 0.5 ng/µL to 20 ng/µL, including from 1 ng/µL to 10 ng/µL.

In producing the primer extension reaction mixture, the primers and target template nucleic acid composition are combined with a number of additional reagents (e.g., to increase specificity, uniformity, yield, etc. of extension products), which may vary as desired. A variety of polymerases may be employed when practicing the subject methods. Reference to a particular polymerase, such as those exemplified below, will be understood to include functional variants thereof unless indicated otherwise. Examples of useful polymerases include DNA polymerases, e.g., where the template nucleic acid is DNA. In some instances, DNA polymerases of interest include, but are not limited to: thermostable DNA polymerases, such as may be obtained from a variety of bacterial species, including *Thermus aquaticus* (Taq), *Thermus thermophilus* (Tth), *Thermus filiformis, Thermus flavus, Thermococcus literalis*, and *Pyrococcus furiosus* (Pfu) or modified and mutated versions of these DNA polymerases (e.g. Phusion DNA polymerase, Q5 DNA polymerase, etc.). Alternatively, where the target template nucleic acid composition is made up of RNA, the polymerase may be a reverse transcriptase (RT), where examples of reverse transcriptases include Moloney Murine Leukemia Virus reverse transcriptase (MMLV RT), e.g., SuprScript II, SuperScript III, MaxiScript reverse transcriptase (Thermo-Fsher), SMARTScribe™ reverse transcriptase (Takara), AMV reverse transcriptase, *Bombyx mori* reverse transcriptase (e.g., *Bombyx mori* R2 non-LTR element reverse transcriptase), etc. In one embodiment, the enzymes with DNA polymerase activity are designed for hot-start primer extension reaction, e.g., used as a complex with specific antibody or chemical compound which blocks enzymatic activity at low temperature but fully releases the activity at reaction conditions. For example, in some instances a hot-start reverse transcriptase composition, e.g. complex between MMLV RT and Therma-Stop RT reagent (Thermagenix) is employed.

Primer extension reaction mixtures also include dNTPs. In certain aspects, each of the four naturally-occurring dNTPs (dATP, dGTP, dCTP and dTTP) are added to the reaction mixture. For example, dATP, dGTP, dCTP and dTTP may be added to the reaction mixture such that the final concentration of each dNTP is from 0.05 to 10 mM, such as from 0.1 to 2 mM, including 0.2 to 1 mM. According to one embodiment, at least one type of nucleotide added to the reaction mixture is a non-naturally occurring nucleotide, e.g., a modified nucleotide having a binding or other moiety (e.g., a fluorescent moiety) attached thereto, a nucleotide analog, or any other type of non-naturally occurring nucleotide that finds use in the subject methods or a downstream application of interest.

In addition to the template nucleic acid, primers, the polymerase, and dNTPs, the reaction mixture may include buffer components that establish an appropriate pH, salt concentration (e.g., KCl concentration), metal cofactor concentration (e.g., $Mg^{2+}$ or $Mn^{2+}$ concentration), and the like, for the extension reaction and template switching to occur. Other components may be included, such as one or more nuclease inhibitors (e.g., an RNase inhibitor and/or a DNase inhibitor), one or more additives for facilitating amplification/replication of GC rich sequences (e.g., GC-Melt™ reagent (Clontech Laboratories, Inc. (Mountain View, Calif.)), betaine, single-stranded binding proteins (e.g., T4 Gene 32, cold shock protein A (CspA), recA protein, and/or the like) DMSO, ethylene glycol, 1,2-propanediol, or combinations thereof), one or more molecular crowding agents (e.g., polyethylene glycol, or the like), one or more enzyme-stabilizing components (e.g., DTT present at a final concentration ranging from 1 to 10 mM (e.g., 5 mM)), and/or any other reaction mixture components useful for facilitating polymerase-mediated extension reactions.

The primer extension reaction mixture can have a pH suitable for the primer extension reaction. In certain embodiments, the pH of the reaction mixture ranges from 5 to 9, such as from 7 to 9, including from 8 to 9, e.g., 8 to 8.5. In some instances, the reaction mixture includes a pH adjusting agent. pH adjusting agents of interest include, but are not limited to, sodium hydroxide, hydrochloric acid, phosphoric acid buffer solution, citric acid buffer solution, and the like. For example, the pH of the reaction mixture can be adjusted to the desired range by adding an appropriate amount of the pH adjusting agent.

The temperature range suitable for production of the product nucleic acid may vary according to factors such as the particular polymerase employed, the melting temperatures of any optional primers employed, etc. According to one embodiment, the primer extension reaction conditions include bringing the reaction mixture to a temperature ranging from 4 to 72° C., such as from 16 to 70° C., e.g., 37 to 65° C., such as 60° C. to 65° C. The temperature of the reaction mixture may be maintained for a sufficient period of time for polymerase mediated, template directed primer extension to occur. While the period of time may vary, in some instances the period of time ranges from 5 to 60 minutes, such as 15 to 45 minutes, e.g., 30 minutes.

In a given primer extension reaction condition, where desired, hybridization complexes of template and primer may be purified, e.g., via separation from excess of non-bound primers, e.g., by nuclease treatment or binding to solid support, e.g., such as beads, e.g., as described above. In this way, excess of primers, such as oligo dT primers and/or gene-specific primers, may be removed in order to achieve a high specificity of primer extension reaction from the target template sequences.

As reviewed above, the barcode labelling step, i.e., where a barcode domain is transferred from an initial donor nucleic acid to a gene-specific primer, may be performed before, after or at the same time as a primer extension step. Transfer is mediated by a ligation reaction, where in some instances linker domains and a linker oligonucleotide are employed to enhance ligation results. Where ligation occurs at the same time as primer extension, primer extension conditions as described may be employed, where reagents necessary for ligase activity, e.g. NAD, ATP, etc., are included. Alternatively, ligation may be carried out in a step separate from primer extension.

Where desired, the primer extension reaction conditions may include one or more temperature cycling steps. For example, in some instances, the primer extension product composition is produced by a method that includes first contacting the target nucleic acid template composition with a first primer subset that includes for example the forward primers of the set of primer pairs under primer extension reaction conditions to produce a forward primer extension product composition; increasing the temperature to denature the resultant product and template strands and inactivate any additional enzymatic activity (e.g., exonuclease I activity added after extension step to degrade PCR primers) present in the forward primer extension product composition (where the elevated temperature may vary, ranging in some instances from 90 to 100° C., such as 95° C.) and then contacting the resultant denatured forward primer extension product composition with a second primer subset that includes the reverse primers of the set of primer pairs under primer extension reaction conditions to produce the desired primer extension product composition. Where desired, the primer extension products and template nucleic acids may be separated from any free forward primers prior to contact with the set of reverse primers. The extended DNA products after the first and second extension steps may be purified from the excess of the primers using any convenient protocol, including primer digestion with exonucleases (exonuclease I) or purification, such as Magnetic beads or spin columns, etc.

Amplification

As reviewed above, in some instances primer extension products are amplified, where amplicons are produced from the primer extension products. The term "amplicon" is employed in its conventional sense to refer to a piece of DNA that is the product of artificial amplification or replication events, e.g., as produced using various methods including polymerase chain reactions (PCR), ligase chain reactions (LCR), etc. Where primer extension products are amplified, the primer extension products, e.g., as described above, may include additional domains that are employed in subsequent amplification steps to produce a desired amplicon composition. For example, as illustrated in FIGS. 1 to 4, flanking anchor domains are provided in the primer extension products, where the flanking anchor domains include universal priming sites which may be employed in PCR amplification.

As such, embodiments of the methods may include combining a primer extension product composition with universal forward and reverse primers under amplification conditions sufficient to produce a desired product barcoded amplicon composition. The forward and reverse universal primers may be configured to bind to the common forward and reverse anchor domains and thereby nucleic acids present in the primer extension product compositions. The universal forward and reverse primers may vary in length, ranging in some instances from 10 to 75 nt, such as 15 to 60 nt.

In some instances, the universal forward and reverse primers include one or more additional domains, such as but not limited to: an indexing domain, a clustering domain, a Next Generation Sequencing (NGS) adaptor domain (i.e., high-throughput sequencing (HTS) adaptor domain), etc. Alternatively, these domains may be introduced during one or more subsequent steps, such as one or more subsequent amplification reactions, e.g., as described in greater detail below. The amplification reaction mixture will include, in addition to the primer extension product composition and universal forward and reverse primers, other reagents, as desired, such polymerase, dNTPs, buffering agents, etc., e.g., as described above.

Amplification conditions may vary. In some instances, the reaction mixture is subjected to polymerase chain reaction (PCR) conditions. PCR conditions include a plurality of reaction cycles, where each reaction cycle includes: (1) a denaturation step, (2) an annealing step, and (3) a polymerization step. The number of reaction cycles will vary depending on the application being performed, and may be 1 or more, including 2 or more, 3 or more, four or more, and in some instances may be 15 or more, such as 20 or more and including 30 or more, where the number of different cycles will typically range from about 12 to 24. The denaturation step includes heating the reaction mixture to an elevated temperature and maintaining the mixture at the elevated temperature for a period of time sufficient for any double stranded or hybridized nucleic acid present in the reaction mixture to dissociate. For denaturation, the temperature of the reaction mixture may be raised to, and maintained at, a temperature ranging from 85 to 100° C., such as from 90 to 98° C. and including 94 to 98° C. for a period of time ranging from 3 to 120 sec, such as 5 to 30 sec. Following denaturation, the reaction mixture will be subjected to conditions sufficient for primer annealing to template DNA present in the mixture. The temperature to which the reaction mixture is lowered to achieve these conditions may be chosen to provide optimal efficiency and specificity, and in some instances ranges from about 50 to 75° C., such as 60 to 74° C. and including 68 to 72° C. Annealing conditions may be maintained for a sufficient period of time, e.g., ranging from 10 sec to 30 min, such as from 10 sec to 5 min. Following annealing of primer to template DNA or during annealing of primer to template DNA, the reaction mixture may be subjected to conditions sufficient to provide for polymerization of nucleotides to the primer ends in manner such that the primer is extended in a 5' to 3' direction using the DNA to which it is hybridized as a template, i.e. conditions sufficient for enzymatic production of primer extension product. To achieve polymerization conditions, the temperature of the reaction mixture may be raised to or maintained at a temperature ranging from 65 to 75, such as from about 68 to 72° C. and maintained for a period of time ranging from 15 sec to 20 min, such as from 20 sec to 5 min. In some embodiments, the annealing stage could be avoided, and protocol could include only denaturation and polymerization steps as described above. The above cycles of denaturation, annealing and polymerization may be performed using an automated device, typically known as a thermal cycler. Thermal cyclers that may be employed are described in U.S. Pat. Nos. 5,612,473; 5,602,756; 5,538,871; and 5,475,610, the disclosures of which are herein incorporated by reference.

The product amplicon composition of this first amplification reaction will include amplicons corresponding to the gene specific domains that are present in the initial target nucleic acid composition and are bounded by primer pairs present in the employed set of gene specific primers and barcode sequence from one side of the amplicon. In some instances, the number of distinct amplicons of differing sequence in this initial amplicon composition ranges from 10 to 19,000, 10 to 15,000, 10 to 10,000, and 10 to 8,000, such as 25 to 18,500, 25 to 12,000, 25 to 8,000, and 25 to 7,500, including 50 to 15,000, 50 to 10,000 and 50 to 5,000, where in some instances the number of distinct amplicons present in this initial amplicon composition is 25 or more, including 50 or more, such as 100 or more, 250 or more, 500 or more, 1,000 or more, 1,500 or more, 2,500 or more, 5,000 or more, 7,500 or more, 8,500 or more, 10,000 or more, 15,000 or more, 18,000 or more. In some instances, this initial amplicon composition includes sequences found in at least a subset of the genes listed in Table 2, e.g., a subset of 10 to 5,000, such as 20 to 5,000, 50 to 5,000, 100 to 5,000, such as 100 to 5,000, including 100 to 4,000, 100 to 3,000, and 100 to 2,000 of the genes listed in Table 2, or in some instances the amplicon composition includes sequences found in all of the genes listed in Table 2. A subject amplicon composition may include or exclude multiple different product amplicons corresponding to same gene as amplified by two or more different primer pairs directed to the gene. The multiple product amplicons making up the amplicon composition may vary in length, ranging in length in some instances from 50 to 1000, such as 60 to 500, including 70 to 250 nt.

The sample barcoded initial product amplicon composition may be employed in a variety of different applications, including evaluation of the expression profile of the sample from which the template target nucleic acid was obtained. In such instances, the expression profile may be obtained from the amplicon composition using any convenient protocol, such as but not limited to differential gene expression analysis, array-based gene expression analysis, NGS sequencing, etc.

For example, the barcoded amplicon composition may be employed in hybridization assays in which a nucleic acid array that displays "probe" nucleic acids for each of the genes to be assayed/profiled in the profile to be generated is employed. In these assays, the amplicon composition is first prepared from the initial target nucleic acid sample being assayed as described above, where preparation may include labeling of the target nucleic acids with a label, e.g., a member of signal producing system. Following amplicon production, e.g., as described above, the sample is contacted with the array under hybridization conditions, whereby complexes are formed between target nucleic acids that are complementary to probe sequences attached to the array surface. The presence of hybridized complexes is then detected, either qualitatively or quantitatively. The detection and quantification of different barcodes could be achieved in the follow-up hybridization steps with labeled targets complementary to barcode domains of the amplicons. Specific hybridization technology which may be practiced to generate the expression profiles employed in the subject methods includes the technology described in U.S. Pat. Nos. 5,143,854; 5,288,644; 5,324,633; 5,432,049; 5,470,710; 5,492,806; 5,503,980; 5,510,270; 5,525,464; 5,547,839; 5,580,732; 5,661,028; 5,800,992; the disclosures of which are herein incorporated by reference; as well as WO 95/21265; WO 96/31622; WO 97/10365; WO 97/27317; EP 373 203; and EP 785 280. In these methods, an array of "probe" nucleic acids that includes a probe for each of the phenotype determinative genes whose expression is being assayed is contacted with target nucleic acids as described above. Contact is carried out under hybridization conditions, e.g., stringent hybridization conditions, and unbound nucleic acid is then removed. The resultant pattern of hybridized nucleic acid provides information regarding expression for each of the genes that have been probed, where the expression information is in terms of whether or not the gene is expressed and, typically, at what level, where the expression data, i.e., expression profile (e.g., in the form of a transcriptome), may be both qualitative and quantitative.

Alternatively, non-array-based methods for quantifying the levels of one or more nucleic acids in a sample may be employed, including quantitative PCR, real-time quantitative PCR, and the like. (For general details concerning real-time PCR see Real-Time PCR: An Essential Guide, K. Edwards et al., eds., Horizon Bioscience, Norwich, U.K. (2004)).

In some embodiments, the method further includes sequencing the multiple barcoded product amplicons, e.g., by using a Next Generation Sequencing (NGS) protocol. In such instances, if not already present, the methods may include modifying the initial amplicon composition to include one or more components employed in a given NGS protocol, e.g., sequencing platform adaptor constructs, indexing domains, clustering domains, etc.

By "sequencing platform adapter construct" is meant a nucleic acid construct that includes at least a portion of a nucleic acid domain (e.g., a sequencing platform adapter nucleic acid sequence) or complement thereof utilized by a sequencing platform of interest, such as a sequencing platform provided by Illumina® (e.g., the NovaSeg™, NexSeg™, HiSeg™, MiSeg™ and/or Genome Analyzer™ sequencing systems); Thermo Fisher (e.g., Ion Torrent™ (such as the Ion PGM™ and/or Ion Proton™ sequencing systems) and Life Technologies™ (such as a SOLiD sequencing system)); Pacific Biosciences (e.g., the PACBIO RS II sequencing system); Roche (e.g., the 454 GS FLX+ and/or GS Junior sequencing systems); Oxford Nanopore technologies (e.g., MinION™, GridION™, PrometION™ sequencing systems) or any other sequencing platform of interest.

In certain aspects, the sequencing platform adapter construct includes a nucleic acid domain selected from: a domain (e.g., a "capture site" or "capture sequence") that specifically binds to a surface-attached sequencing platform oligonucleotide (e.g., the P5/i5 or P7/i7 oligonucleotides attached to the surface of a flow cell in an Illumina® sequencing system); where the construct may include one or more additional domains, such as but not limited to: a sequencing primer binding domain or clustering domain (e.g., a domain to which the Read 1 or Read 2 primers of the Illumina® platform may bind); a indexing domain (e.g., a domain that uniquely identifies the sample source of the nucleic acid being sequenced to enable sample multiplexing by marking every molecule from a given sample with a specific index or "tag"); a barcode sequencing primer binding domain (a domain to which a primer used for sequencing a barcode binds); a unique molecular identification domain (e.g., a molecular index tag, such as a randomized tag of 4, 6, or other number of nucleotides) for uniquely marking molecules of interest to determine expression levels based on the number of instances a unique tag is sequenced; a complement of any such domains; or any combination thereof. In certain aspects, a barcode domain (e.g., sample index tag) and a molecular identification domain (e.g., a molecular index tag) may be included in the same nucleic acid.

The sequencing platform adapter constructs may include nucleic acid domains (e.g., "sequencing adapters") of any length and sequence suitable for the sequencing platform of interest. In certain aspects, the nucleic acid domains are from 4 to 200 nucleotides in length. For example, the nucleic acid domains may be from 4 to 100 nucleotides in length, such as from 6 to 75, from 8 to 50, or from 10 to 40 nucleotides in length. According to certain embodiments, the sequencing platform adapter construct includes a nucleic acid domain that is from 2 to 8 nucleotides in length, such as from 9 to 15, from 16-22, from 23-29, or from 30-36 nucleotides in length.

The nucleic acid domains may have a length and sequence that enables a polynucleotide (e.g., an oligonucleotide) employed by the sequencing platform of interest to specifically bind to the nucleic acid domain, e.g., for solid phase amplification and/or sequencing by synthesis of the cDNA insert flanked by the nucleic acid domains. Example nucleic acid domains include the P5 (5'-AATGATACGGCGAC-CACCGA-3') (SEQ ID NO:03), P7 (5'-CAAGCAGAA-GACGGCATACGAGAT-3')(SEQ ID NO:04), Read 1 primer (5'-ACACTCTTTCCCTACACGACGCTCTTCC-GATCT-3') (SEQ ID NO:05) and Read 2 primer (5'-GTGACTGGAGTTCAGACGTGTGCTCTTCCGATCT-3') (SEQ ID NO:06) domains employed on the Illumina®-based sequencing platforms. Other example nucleic acid domains include the A adapter (5'-CCATCT-CATCCCTGCGTGTCTCCGACTCAG-3')(SEQ ID NO:07) and P1 adapter (5'-CCTCTC-TATGGGCAGTCGGTGAT-3')(SEQ ID NO:08) domains employed on the Ion Torrent™-based sequencing platforms.

The nucleotide sequences of nucleic acid domains useful for sequencing on a sequencing platform of interest may vary and/or change over time. Adapter sequences are typically provided by the manufacturer of the sequencing platform (e.g., in technical documents provided with the sequencing system and/or available on the manufacturer's website). Based on such information, the sequence of the sequencing platform adapter construct of the template switch oligonucleotide (and optionally, a first strand synthesis primer, amplification primers, and/or the like) may be designed to include all or a portion of one or more nucleic acid domains in a configuration that enables sequencing the nucleic acid insert (corresponding to the template nucleic acid) on the platform of interest.

The sequencing adaptors may be added to the amplicons of the initial amplicon composition using any convenient protocol, where suitable protocols that may be employed include, but are not limited to: amplification protocols, ligation protocols, etc. In some instances, amplification protocols are employed. In such instances, the initial amplicon composition may be combined with forward and reverse sequencing adaptor primers that include one or more sequencing adaptor domains, e.g., as described above, as well as domains that bind to universal primer sites found in all of the amplicons in the composition, e.g., the forward and reverse anchor domains, such as described above. As reviewed above, amplification conditions may include the addition of forward and reverse sequencing adaptor primers configured to bind to the common forward and reverse anchor domains and thereby amplify all or a desired portion of the product nucleic acid, dNTPs, and a polymerase suitable for effecting the amplification (e.g., a thermostable polymerase for polymerase chain reaction), where examples of such conditions are further described above. The forward and reverse sequencing adaptor primers employed in these embodiments may vary in length, ranging in length in some instances from 20 to 60 nt, such as 25 to 50 nt. Addition of NGS sequencing adaptors results in the production of a composition which is configured for sequencing by an NGS sequencing protocol, i.e., an NGS library.

In certain aspects, the methods of the present disclosure further include subjecting the NGS library to NGS protocol, e.g., as described above. The NGS protocol will vary depending on the particular NGS sequencing system employed. Detailed protocols for sequencing an NGS library, e.g., which may include further amplification (e.g., solid-phase amplification), sequencing the amplicons, and analyzing the sequencing data are available from the manufacturer of the NGS system employed. Protocols for performing next generation sequencing, including methods of processing the sequencing data, e.g., to count and tally sequences and assemble transcriptome data therefrom, are further described in published United States Patent Application 20150344938, the disclosure of which is herein incorporated by reference.

Pooling

Where desired, a given workflow may include a pooling step where a product composition, e.g., made up of synthesized first strand cDNAs or synthesized double stranded cDNAs, is combined or pooled with product compositions obtained from one or more additional samples, e.g., cells. The number of different product compositions produced from different samples, e.g., cells, that are combined or pooled in such embodiments may vary, where the number ranges in some instances from 2 to 50,000, such as 3 to 25,000, including 4 to 20,000 such as 5 to 10,000, where in some instances the number ranges from 100 to 10,000, such as 1,000 to 5,000.

Prior to or after pooling, the product composition(s) can be amplified, e.g., by polymerase chain reaction (PCR), such as described above.

Template Switch

In some embodiments, the primer reaction extension conditions using RNA template could incorporate a template switching oligonucleotide, e.g., with optional sample-specific barcode domain and anchor domain. Template switch is described in U.S. Pat. Nos. 5,962,271 and 5,962,272, as well as Published PCT application Publication No. WO2015/027135; the disclosures of which are herein incorporated by reference. Under the primer extension conditions, the template switching oligonucleotide could be employed by reverse transcriptase as a second template in the primer extension reaction. As a result of this extension reaction, the sample-specific barcode sequences of the template switch oligonucleotide will be incorporated to the 3'-end of the synthesized cDNA. In another embodiment, in addition to template switching oligonucleotide the extension reaction could also include a set of gene-specific oligonucleotides complementary to the target regions of RNA templates. This set of gene-specific oligonucleotides is designed as complementary sequences to the gene-specific portion of forward gene-specific primers and with the sequences or modification at the 3'-end which block extension of these oligonucleotides by reverse transcriptase. Under this disclosed condition, the RNase H activity of reverse transcriptase (or RNAse H enzyme which could be added externally), will degrade the RNA target region complementary to the gene-specific oligonucleotide, thus generating target RNA template truncated at the sites selected for design of forward gene-specific primers. Using of target RNA templates specifically truncated at the sites of forward gene-specific primers will allow to add at this site the sample-specific barcode encoded by template switching oligonucleotide by extension of reverse gene-specific primers with reverse transcriptase. Therefore, the extension reaction composition comprising target RNAs, barcoded template switching oligonucleotides, oligonucleotides complementary to gene-specific portion of forward gene-specific primers and reverse gene-specific primers allow to specifically extend and barcode the target amplicon regions in a single reaction step catalyzed by reverse transcriptase.

Utility

The subject methods find use in a variety of applications, including expression profiling or transcriptome determination applications, where a sample is evaluated to obtain an expression profile of the sample. By "expression profile" is meant the expression level of a gene of interest in a sample, which may be a single cell or a combination of multiple cells (e.g., as determined by quantitating the level of an RNA or protein encoded by the gene of interest), or a set of expression levels of a plurality (e.g., 2 or more) of genes of interest. In certain aspects, the expression profile includes expression level data for 1, 2 or more, 5 or more, 10 or more, 20 or more, 50 or more, 100 or more, 200 or more, 300 or more, 400 or more, 500 or more, 1,000 or more, 5,000 or more, 10,000 or more, 15,000 or more, e.g., 18,000 or more genes of interest. According to one embodiment, the expression profile includes expression level data of from 50 to 8000 genes of interest, e.g., from 1000 to 5000 genes of interest. In some embodiments, the expression profile includes expression level data of from 50 to 19,000 genes of interest, e.g., from 1000 to 18,000 genes of interest. In certain aspects, the methods may be employed detecting and/or quantitating the expression of all or substantially all of the cancer associated genes transcribed in a target cell. In a preferred embodiment, the methods are described for profiling all known cell and tissue marker genes, as listed in Table 2. In certain aspects, the methods may be employed detecting and/or quantitating the expression of all or substantially all of the genes transcribed by an organism, e.g., a mammal, such as a human or mouse, in a target cell. The terms "expression" and "gene expression" include transcription and/or translation of nucleic acid material. For example, gene expression profiling may include detecting and/or quantitating one or more of any RNA species transcribed from the genomic DNA of the target cell, including pre-mRNAs, mRNAs, non-coding RNAs, microRNAs, small RNAs, regulatory RNAs, and any combination thereof.

Expression levels of an expressed sequence are optionally normalized by reference or comparison to the expression level(s) of one or more control expressed genes, including but not limited to, ACTB, GAPDH, HPRT-1, RPL25, RPS30, and combinations thereof. These "normalization genes" have expression levels that are relatively constant among target cells in the cellular sample.

In some instances, quantitative analysis of gene expression using set of calibration control template composition is performed. Internal calibration control templates which mimic but differ from natural target RNAs and spiked into cell or cell lysates at specific amount may be effectively used for truly quantitative expression analysis. The calibration control RNAs could be developed for the set of genes (e.g. cell marker genes) or for genome-wide set of transcripts. In order to address the reproducibility of the profiling assay for multiple biological samples (e.g. thousands of single cells), embodiments of the invention uniquely employ the strategy of using barcoded reverse gene specific primers. Target template RNAs (e.g., present in cell extracts) hybridized with barcoded reverse gene specific primers could be combined for the all follow-up steps. The strategy of barcoding and combining target RNAs at early (hybridization) stage allows for significantly reduced cost of the assay, eliminates sample-to-sample profiling variability due to differences in experimental assay conditions, etc. The developed protocol which addresses sample-to-sample and batch effect variability has significant utility in biomarker discovery in clinical samples (e.g., whole blood).

According to certain embodiments, the expression profile includes "binary" or "qualitative" information regarding the expression of each gene of interest in a target cell. That is, in such embodiments, for each gene of interest, the expression profile only includes information that the gene is expressed or not expressed (e.g., above an established threshold level) in the sample being analyzed, e.g., tissue, cell, etc. In other embodiments, the expression profile includes quantitative information regarding the level of expression (e.g., based on rate of transcription, rate of splicing and/or RNA abundance) of one or more genes of interest. A qualitative and/or quantitative expression profile from the sample may be compared to, e.g., a comparable expression profile generated from other samples and/or one or more reference profiles from cells known to have a particular biological phenotype or condition (e.g., a disease condition, such as a tumor cell; or treatment condition, such as a cell treated with an agent, e.g., a drug). When the profiles being compared are quantitative expression profiles, the comparison may include determining a fold-difference between one or more genes in the expression profile of a target cell and the corresponding genes in the expression profile(s) of one or more different target cells in the cellular sample, or the corresponding genes in a reference cell or cellular sample. Alternatively, or additionally, the expression profile may include information regarding the relative expression levels of different genes in a single target cell. In certain aspects, the fold difference in intercellular expression levels or intracellular expression levels can be determined to be 0.1 or more, 0.5 fold or more, 1 fold or more, 1.5 fold or more, 2 fold or more, 2.5 fold or more, 3 fold or more, 4 fold or more, 5 fold or more, 6 fold or more, 7 fold or more, 8 fold or more, 9 fold or more, or more than 10 fold or more, for example.

In some instances, the methods may be employed to determine the transcriptome of a sample. The term "transcriptome" is employed in its conventional sense to refer to the set of all messenger RNA molecules in one cell or a population of cells. In some instances, a transcriptome includes the amount or concentration of each RNA molecule in addition to the molecular identities. The methods described herein may be employed in detecting and/or quantitating the expression of all genes or substantially all genes of the transcriptome of an organism, e.g., a mammalian organism, such as a human or a mouse, for a particular target cell or a population of cells.

Expression profiles obtained using methods of the invention may be employed in a variety of applications. For example, an expression profile may be indicative of the biological condition of the sample or host from which the sample is obtained, including but not limited to a disease condition (e.g., a cancerous condition, metastatic potential, an epithelial mesenchymal transition (EMT) characteristic, and/or any other disease condition of interest), the condition of the cell in response to treatment with any physical action (e.g., heat shock, hypoxia, normoxia, hydrodynamic stress, radiation, and/or the like), the condition of the cell in response to treatment with chemical compounds (e.g., drugs, cytotoxic agents, nutrients, salts, and/or the like) or biological extracts or entities (e.g., viruses, bacteria, other cell types, growth factors, biologics, and/or the like), and/or any other biological condition of interest (e.g. immune response, senescence, inflammation, motility, and/or the like).

Embodiments of the invention find further application in tumor microenvironment analysis applications. Transcriptome data obtained, e.g., as described above, may be employed to determine the cellular constitution of a tumor sample, e.g., to provide an evaluation of the types of cells present in a tumor sample, such as infiltrating hematopoietic cells, tumor cells and bulk tissue cells. For example, transcriptome data may be employed to assess whether a tumor sample does not include infiltrating immune cells, including those of the adaptive and/or innate immune system, such as but not limited to: T, B, natural killer, monocyte, granulocytes, neutrophils, basophils, platelets, and their myeloid and lymphoid progenitor cells, hematopoietic stem cells, and the like. Such information may be used, e.g., in therapy determination applications, for example where the presence of infiltrating immune cells indicates that a patient will be responsive to immunotherapy while the absence of infiltrating immune cells indicates that a patient will not be responsive to immunotherapy. As such, aspects of the invention include methods of therapy determination, where a patient tumor sample is evaluated to assess the tumor microenvironment. Aspects of the invention may further include making a determination to employ an immunotherapy protocol is made if the tumor microenvironment includes infiltrating tumor cells and a determination is made to employ a non-immunotherapy treatment regimen if the tumor microenvironment lacks infiltrating immune cells.

Methods as described here also find use in large-scale profiling of single-cell phenotypes derived from model system (e.g., cultivated cells, organoid cultures, 3D cultures, etc.,), model organisms (e.g., mice, rat, monkey, etc.) and clinical samples derived from normal or pathological conditions (e.g., blood, biopsy, sputum, saliva, etc.). Currently, there is a substantial need for comprehensive characterization of different cell types present in normal and pathological conditions. The disclosed methods and compositions provide an improved technological platform for large-scale discovery of key cellular markers for developing novel diagnostic and prognostic tools.

Transcriptome data, e.g., produced as described above, also finds use in other non-clinical applications, such as predictive and prognostic biomarker discovery applications, evaluation of cancer immunoediting mechanism applications, drug target discovery, and the like.

Compositions

Aspects of the invention further include various compositions. Compositions of the invention may include, e.g., one or more of any of the reaction mixture components described above with respect to the subject methods, where the reaction mixtures may be present in a nucleic acid amplification device, such as in a container of such a device. For example, the compositions may include one or more of a target nucleic acid template (e.g., genomic DNA sample, cDNA sample, RNA sample, etc.), individual cells or group of cells, a polymerase (e.g., a thermostable polymerase), ligase, a set of gene specific primers, barcoded oligonucleotides (e.g., donor nucleic acids), primers for cDNA synthesis, dNTPs, NAD, ATP, a salt, a metal cofactor, one or more nuclease inhibitors (e.g., an RNase inhibitor), one or more enzyme-stabilizing components (e.g., DTT), or any other desired reaction mixture component(s). Composition may vary for the different steps of the disclosed methods. For example, for cDNA synthesis steps the compositions may include only reagents necessary for reverse transcription and for the subsequent ligation step the composition may employ a different buffer, oligonucleotides and enzymes (DNA ligase) components. Some components of composition (e.g., barcoded oligonucleotides), may be immobilized on a solid surface (e.g., plate wall, beads, etc.). Also provided are compositions that include a primer extension product composition, and barcoded primer extension product composition, e.g., as described above. Also provided are barcoded amplicon compositions and NGS libraries, such as described above.

In certain embodiments disclosed in the application, the different compositions are physically separated from each other, e.g., they are present or deposited in different wells or plate or in microdroplets. For example, compositions comprising a plurality of single barcoded oligonucleotides immobilized on bead and single cell sample could be present in each microdroplet. In other embodiments, the plurality of barcoded compositions (e.g., hybridization complexes between target RNAs and barcoded reverse gene specific primers or barcoded primer extension product compositions) are mixed together and used as a mix of different compositions in all follow-up steps. In such instances, the different compositions may include the common components necessary to perform hybridization, enzymatic modification, e.g., primer extension, purification, etc. steps and unique components which are specific for each biological sample, e.g., individual cells, purified nucleic acid from each sample, and sample-specific barcoded oligonucleotide, as described in a more details above.

The subject compositions may be present in any suitable environment. According to one embodiment, the compositions are present in reaction tubes (e.g., a 0.2 mL tube, a 0.5 mL tube, a 1.5 mL tube, or the like) or a well. In certain aspects, the compositions are present in two or more (e.g., a plurality of) reaction tubes or wells (e.g., a plate, such as a 96-well plate). The tubes and/or plates may be made of any suitable material, e.g., polypropylene, or the like. In certain aspects, the tubes and/or plates in which the composition is present provide for efficient heat transfer to the composition (e.g., when placed in a heat block, water bath, thermocycler, and/or the like), so that the temperature of the composition may be altered within a short period of time, e.g., as necessary for a particular hybridization or enzymatic reaction to occur. According to certain embodiments, the composition is present in a thin-walled polypropylene tube, or a plate having thin-walled polypropylene wells. Other suitable environments for the subject compositions include, e.g., a microfluidic chip (e.g., a "lab-on-a-chip device"). The composition may be present in an instrument configured to bring the composition to a desired temperature, e.g., a temperature-controlled water bath, heat block, or the like. The instrument configured to bring the composition to a desired temperature may be configured to bring the composition to a series of different desired temperatures, each for a suitable period of time (e.g., the instrument may be a thermocycler).

In another embodiment, the different compositions are present or delivered to microwells of microplates with well sizes dimensioned to accommodate individual cells, where the dimensions may be configured to accommodate on average no more than 2 cells, such as no more than 1 cell. Examples of such wells are those found in the plates of the Rhapsody instrument (Becton, Dickinson and Company), the ICELL8 instrument (Takara Bio USA), etc. where such instruments employ plates having approximately 10,000 wells and a deposition protocol for individual cells and single beads.

In another embodiment, the different compositions are present in microdroplets. For example, emulsion PCR may be employed. For emulsion PCR, an emulsion PCR reaction (e.g., in a droplet, droplet microreactor) is created with a "water in oil" mix to generate thousands or millions of micron-sized aqueous compartments. Sources of nucleic acids (e.g., cells, nucleic acid libraries, optionally coupled to solid supports, e.g., beads) are mixed in a limiting dilution prior to emulsification or directly into the emulsion mix. The combination of compartment size and limiting dilution of the nucleic acid sources is used to generate compartments containing, on average, just one source of nucleic acid (e.g., cell, or sample nucleic acid(s), such as cellular nucleic acid—e.g., RNA combined with a solid support, such that the nucleic acids may be stably associated with the solid support (e.g., bead) etc.). Depending on the size of the aqueous compartments generated during the emulsification step, up to $3 \times 10^9$ individual amplification reactions per μl can be conducted simultaneously in the same container, e.g., tube, well, or other suitable container. The average size of a compartment in an emulsion ranges from sub-micron in diameter to over 100 microns, depending on the emulsification conditions. Protocols that may be employed include those that allow one to deliver individual cells with unique barcoded beads and reagents necessary for reverse transcription step into separate microdroplets. Such microdroplet technologies include the Chromium instrument (10× Genomics), the ddSeq instrument (Bio-Rad), etc. Microdroplets that include compositions as described above may also be generated and delivered to separate compartments or to oil (to form water-oil droplets) using conventional technologies, e.g., FACS, ink-jet deposition, etc.

Kits

Aspects of the present disclosure also include kits. The kits may include, e.g., one or more of any of the reaction mixture components described above with respect to the subject methods. For example, the kits may include one or more of: a set of gene specific primers, barcoded oligonucleotides (e.g., donor nucleic acids, e.g., immobilized on the beads), a polymerase (e.g., a thermostable polymerase, a reverse transcriptase, or the like), ligase (e.g. DNA ligase), dNTPs, a salt, a metal cofactor, NAD, ATP, one or more nuclease inhibitors (e.g., an RNase inhibitor and/or a DNase inhibitor), one or more molecular crowding agents (e.g., polyethylene glycol, or the like), one or more enzyme-stabilizing components (e.g., DTT), or any other desired kit component(s), such as solid supports, e.g., tubes, beads, microfluidic chips, etc.

Components of the kits may be present in separate containers, or multiple components may be present in a single container. For example, the individual barcoded oligonucleotides could be provided pre-aliquoted in separate wells or attached/encapsulated with different beads, and mixture of all beads is provided as kit components. In certain embodiments, it may be convenient to provide the components in a lyophilized form, so that they are ready to use and can be stored conveniently at room temperature.

In addition to the above-mentioned components, a subject kit may further include instructions for using the components of the kit, e.g., to practice the subject method. The instructions are generally recorded on a suitable recording medium. For example, the instructions may be printed on a substrate, such as paper or plastic, etc. As such, the instructions may be present in the kits as a package insert, in the labeling of the container of the kit or components thereof (i.e., associated with the packaging or subpackaging) etc. In other embodiments, the instructions are present as an electronic storage data file present on a suitable computer readable storage medium, e.g. CD-ROM, diskette, Hard Disk Drive (HDD), portable flash drive, etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

The following examples are offered by way of illustration and not by way of limitation.

EXPERIMENTAL

I. Barcoding Via Reverse Gene Specific Primer Extension

The objective of this experiment is to demonstrate performance of expression profiling in sorted cells or cell mixes using a set of gene specific primers pairs, i.e., the 1.3K Cell-Tissue Marker primer set (1.3K hCTM) as detailed Table 2 using the protocol illustrated in FIG. 1.

A. Hybridization of Gene-Specific Primers and Sample-Barcoded Donor Nucleic Acid to mRNA Sample Individual cells are isolated using a microfluidic cartridge or sorting technology. Each of the individual cells (or cell samples) are mixed with TLC lysis buffer (Qiagen)(e.g. 5-µl for single cell), RevGSP-L1 primers (1.3K human Cell Marker primer set, Table 2) and a set of T30-Anc2-BC-UMI-L2 donor nucleic acids immobilized on beads (Chem-Genes) (where each set of donor nucleic acids for each cell varies only by the UMI domain and each cell contacted with its own unique set of donor nucleic acids that differs from any other set used with the any other cell by the BC domain). The donor nucleic acids and RevGSP-L1 Primers are hybridized to the cellular RNA at 50° C. for 30 min. The structures of the donor nucleic acid and RevGSP primers employed in this step are provided below:

```
RevGSP-L1 Primer:
                                           (SEQ ID NO: 09)
              L1 domain
3'<RevGSP-AGCACCGACCAGCACCp-5'

T30-Anc2-UMI-BC-L2:
                                           (SEQ ID NO: 10)
              L2 domain
3'GCCAGCACGCCACCA-(UMI-BC)XGXCACGACCAGCCACG Anchor 2 domain
A(NVT30)-Bead
```

An example of a T30-Anc2-UMI-BC-L2 donor nucleic acid showing an exemplary UMI8 domain (unique molecular identifier of 8 residues in length) and a BC14 domain (sample barcode of 14 residues in length) is provided below:

```
                                           (SEQ ID NO: 11)
   T30VN                   Anc2
TTTTTTTTTTTTTTTTTTTTTTTTTTTTTTVNAGCACCGACCAGCAXXGX

UMI8       BC14          L2
VVNVVNVVGCCCAGGAAGCCGAACCACCGCACGACCG
```

Beads with immobilized mRNA, dT30-Anc2-BC-UMI and RevGSP-L2 primers produced from different cells/samples are then pooled together and washed with TCW buffer (Qiagen).

B. Ligation of Gene Specific Primers to Donor Nucleic Acids

The double-stranded complexes formed between polyA+ mRNA, T30-Anc2-UMI-BC-L2 donor nucleic acid and RevGSP-L1 Primer as shown in FIG. 1 are then contacted under hybridization conditions with a complementary ligation linker oligonucleotide (L1-L2) having the following sequence:

```
                                           (SEQ ID NO: 12)
A-TCGTGGCTGGTCGTGG--CGGTCGTGCGGTGGT-3'dT
      L1-L2
```

Specifically, beads with immobilized complex between polyA+ mRNA and T30-Anc2-UMI-BC-L2 and Rev-GSP-L1 as described above are mixed with 10-µl of Multiplex Reverse Transcription master mix (DriverMap kit, Cellecta, Inc. Mountain View, Calif.), where the mix includes the L1-L2 ligation linker (20 nM), Ampligase (Epicentre, 1/250 dilution) and NAD (1 mM) as well as all reagents required for reverse transcription. The resultant reaction mixture is incubated at 50° C. for 30 min. The beads are treated with 1-µl of ExoI (20 units/µl, New England Biolabs) at 37° C., 30 min, and washed with TCW buffer.

As a result, the L1 and L2 domains of the RT and RevGSP primers are brought together as shown in FIG. 1 and also illustrated in the following structure:

```
                                    (SEQ ID NOs: 12, 13 and 14)
3'           L1         5' 3'       L2
<RevGSP-AGCACCGACCAGCACCp GCCAGCACGCCACCA-(BC14-

T30-Anc2-BC-UMI        5'
UMI8)-XGXCACGACCAGCCACGA(NVT30)-Bead

A-TCGTGGCTGGTCGTGG--CGGTCGTGCGGTGGT-3'dT <Anc2
                L1-L2
```

The Ampligase catalyzes ligation between the L1 and L2 domains resulting in the BC14, UMI8 and Anc2 domains being transferred to the reverse gene specific primer, such that the reverse gene specific primer is labeled with BC14-UMI8-Anc2 domains necessary for barcoding and amplification of gene specific extension products as described in the following steps. First strand cDNA is also synthesized in this step, as illustrated in FIG. 1.

C. Forward (FWD) GSP Extension-Second Strand cDNA Production

Resultant barcoded first strand cDNA products immobilized on beads produced in Step B, above, are subjected to a second round of extension to produce second strand cDNA. For this step, Anchor 1-Fwd GSP primers (1.3K hCTM primers) are employed, having the structure:

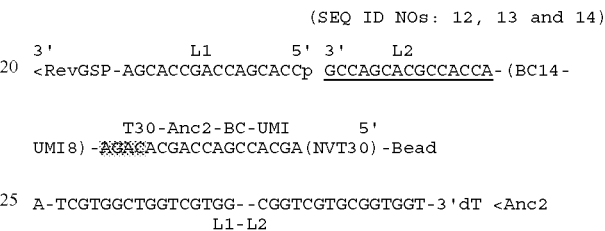

```
                                           (SEQ ID NO: 15)
     Anchor 1
5' XGXAGCACCGACCAGCAGACA-Fwd GSP-3'
```

In this step, the barcoded cDNA products immobilized on beads produced in Step B, above, are combined with 10-µl of Extension master mix (DriverMap kit, Cellecta, Inc., Mountain View, Calif.) that includes 1 nM of each Anchor 1-Fwd GSP primer and DNA polymerase at 64° C. for 30 min, followed by treatment with 1-µl of ExoI (20 units/ul, New England Biolabs) at 37° C. for 30 min. The beads are then washed with TCW buffer.

D. 1st PCR

Anchored DNA fragments produced in Step C are amplified in 50-µl of Multiplex DNA polymerase reaction mix (DriverMap kit) with universal anchor PCR primers (Fwd-Anc1 and Rev-Anc2) as shown below for 14-20 cycles.

```
PCR primers for 1st PCR Step:
Fwd-Anc1
                                    (SEQ ID NO: 16)
AGCAGCACCGACCAGCAGACA Fwd-Anc2
                                    (SEQ ID NO: 17)
ACGAGCACCGACCAGCACAGA
```

This first round of PCR results in production of sample-barcoded anchor-domain-flanked double-stranded gene specific DNA fragments having the following structure:

products are quantitated by Qubit fluorescence measurement, and diluted to 10 nM (2 ng/μl) for next-generation sequencing using NextSeq500 Illumina platform.

II. Variations of Example 1 Protocol

A. In a variation of the protocol described in Example I, only RevGSP-L1 primers are hybridized with polyA+ mRNA in solution following which the resultant hybridization complexes are purified. The purified hybridization complexes are then combined T30-Anc2-UMI-BC-L2 donor nucleic acids or a variant thereof lacking the T30 domain in the (SEQ ID NOs: 18 and 19)

```
         Anc1           Fwd         L2              L1
AGCAGCACCGACCAGCAGACA-GSP>sDNA--GSP-ACCACCGCACGACCGCCACGACCAGCCACGA-(BC14-UMI8)-TCTGTGCTGGTCGGTGCTCGT

TCGTCGTGGCTGGTCGTCTGT-GSP>asDNA-GSP-TGGTGGCGTGCTGGCGGTGCTGGTCGGTGCT-(BC14-UMI8)-AGACACGACCAGCCACGAGCA
                Rev                                                                          Anc2
```

E. 2nd PCR

2-μl aliquot of the 1st PCR amplicon product produced in Step D, above, is added to multiplex DNA polymerase reaction mix (50-μl) and amplified using P7-Anc1 and P5-Anc2 PCR primers with different indexes, as shown below:

```
2nd PCR amplification primers:
P7-Anc1
                                    (SEQ ID NO: 20)
        P7                      Anc1
AGCAGAAGACGGCATACGAGAT AGCAGCACCGACCAGCAGACA P5-Anc2
                                    (SEQ ID NO: 21)
         P5                     Anc2
ACGGCGACCACCGAGATCTACAC ACGAGCACCGACCAGCACAGA
``` presence of the L1-L2 ligation linker under ligation conditions to join the BC-UMI domains to the RevGSP-L1 primers.

B. In a second variation of the protocol described in Example I, RevGSP-L1 primers are hybridized with polyA+ mRNA in conjunction with oligo dT immobilized on beads or test tubes following which the resultant hybridization complexes are purified. The purified hybridization complexes are then combined Anc2-UMI-BC-L2 in the presence of the L1-L2 ligation linker under ligation conditions to join the BC-UMI domains to the RevGSP-L1 primers.

III. Barcoding Via Circular Intermediate

A. First Strand cDNA Synthesis.

50 ng of total RNA (human Brain RNA, Thermo-Fisher) is mixed with a set of T25-Anc1-UMI-BC-L2 donor nucleic acids that differ from each other with respect to the UMI domain at a 1 μM final concentration. Each of the T25-Anc1-UMI-BC-L2 donor nucleic acids is an oligo dT primer The reaction mixture is amplified for 7 cycles, treated with ExoI (0.5 μl) at 37° C. for 30 min. The resultant adaptor containing sample-barcoded anchor-domain-flanked double-stranded gene specific DNA fragments have the following structure:

(SEQ ID NOs :22 and 23)

```
            Anc1          Fwd        L2              L1
P7-AGCAGCACCGACCAGCAGACA-GSP>sDNA--GSP-ACCACCGCACGACCGCCACGACCAGCCACGA-(BC14-UMI8)-TCTGTGCTGGTCGGTGCTCG
T-P5

P7-TCGTCGTGGCTGGTCGTCTGT-GSP>asDNA-GSP-TGGTGGCGTGCTGGCGGTGCTGGTCGGTGCT-(BC14-UMI8)-AGACACGACCAGCCACGAG
                   Rev                                                                         Anc2
CA-P5
```

The resultant adaptor containing sample-barcoded anchor-domain-flanked double-stranded gene specific DNA fragments are analyzed by gel (if necessary, combined at equal amount based on the smear analysis (180-400 bp range) for several samples), and purified using 1.8V of AMPpure magnetic beads (Beckman Coulter). The purified cDNA configured for cDNA synthesis, where the primers include a sample specific barcode domain (BC14), universal molecular index domain (UMI8), a ligation linker domain (L2), anchor domain (Anc1) and template binding domain (oligo dT25VN). The T25-Anc1-UMI-BC-L2 donor nucleic acids have the following structure:

(SEQ ID NO: 24)
```
  L2            BC14        UMI8       Anc1          dT25VN
CGGTCGTGCGGTGGTNNNNNNNNNNNNNNNNNNNNNNTGCTGGTCGGTGCTTTTTTTTTTTTTTTTTTTTTTTTTVN
```

The resultant reaction mixture is treated at 72° C. for 2 min, cooled to 4° C. and reverse transcribed in 1×RT reaction buffer using Maxima reverse transcriptase (Thermo-Fisher) at 50° C. for 30 min in 10-μl reaction mix (Thermo-Fisher), following which RT is inactivated at 95° C. for 5 min. The resultant first strand cDNA product composition is combined with a second first strand cDNA product composition prepared from 50 ng human universal RNA (Agilent Technologies) from a second set of T25-Anc1-UMI-BC-L2 RT primers having a BC domain different from that used with the human Brain RNA. The resultant pooled samples are purified using RNA/DNA micro isolation kit (Qiagen) using manufacturer protocol and eluted in 14-μl of water.

B. Forward Gene-Specific Primer Extension Second Strand cDNA Synthesis and Ligation Step.

14 μl of the first strand cDNA composition produced as described in Step A, above, is mixed with 11 μl of Multiplex DNA polymerase master reaction mix (DriverMap kit, Cellecta) that includes the pool of L-1 Forward 1.3K CTM GSP primers (Table 2) (final concentration 1 nM of each primer). The L-1 Forward gene specific primers (L-1 Fwd GSPs) have the following structure:

```
    L1-Fwd GSP
                                         (SEQ ID NO: 25)
         L1
    CCACCGACCAGCCACGA-Fwd GSP
```

Hybridized L1-Fwd GSPs are extended for 1 cycle at 64° C. extension temperature (30 min), treated with 14 of ExoI (New England BioLabs) for 30 min at 37° C., and 95° C. for 5 min.

The resultant forward gene specific primer extension product composition (i.e., second strand cDNA composition) is then mixed with DNA ligation master mix (54) that includes DNA polymerase master mix with L1-L2 ligation linker oligonucleoptide (20 nM) complementary to the both ends of the forward primer driven second strand cDNA and 1× buffer with AmpliTaq DNA ligase (10 units, Epicentre), 1 mM NAD (Sigma). The L1-L2 ligation linker has the following structure:

```
                                         (SEQ ID NO: 26)
    ATCGTGGTGGTCGTGGCGGTCGTGCGGTGGTA/3InvdT/
```

Combination of the forward gene specific primer extension product (second strand cDNA) composition with the L1-L2 linker results in production of a circular nucleic acid loop intermediate made up of the second strand cDNA whose ends are held together by the L1-L2 linker, as illustrated below:

The resultant reaction mixture is ligated for 5 cycles: (95° C. for 20 sec, 65° C. for 1 min). Ligated circle products are purified by AMPpure beads (1.8× volume, Beckman Coulter) according to manufacturer's protocol. In the course of ligation of the above circular intermediate by DNA ligase (between L1 and L2 linker domains), the universal primer binding domain (Anc1), unique molecular index domain (UMI8) and sample barcode domain (BC14) are transferred to the forward gene specific domain in the final single-stranded circular structure, as illustrated in FIG. 2.

C. Reverse Gene Specific Primer Extension Step

The ligated second strand circular cDNA composition produced is Step B, above, is then subjected to a reverse gene specific primer (RevGSP) round of extension with 5-μl of DNA polymerase master mix that includes 1.3K CTM reverse gene specific primers which include a second anchor domain, i.e., Anc2. The Anc2-Rev GSPs have the following structure:

```
       Anc2-Rev GSP
                                         (SEQ ID: NO 29)
              Anc2
       ACGAGCACCGACCAGCACAGA-Rev GSP
```

For this step, the same conditions as employed for the first forward gene-specific primer extension step are used, and the resultant product is treated with 1-μl of ExoI at 37° C. for 30 min, and 95° C. for 5 min.

D. First PCR

Anchored cDNA fragments produced in Step C, above, are then amplified in 100-μl of Multiplex DNA polymerase reaction mix (DriverMap kit, Cellecta) with universal anchor PCR primers (Anc1 and Anc2) for 16 PCR cycles (98° C. for 10 sec, 72° C. for 20 sec). The universal anchor PCR primers have the following structures:

```
              Anc1
                                         (SEQ ID NO: 30)
         AGCAGCACCGACCAGCAGACA

Anc2
                                         (SEQ ID NO: 31)
         ACGAGCACCGACCAGCACAGA
```

This first PCR results in the production of sample-barcoded anchor-domain-flanked double-stranded gene specific deoxyribonucleic acid (DNA) fragments having the structure:

(SEQ ID NOs: 26, 27 and 28)
```
              Anc1                              L2       3' 5'      L1             Fwd
Loop-sDNA-A25--AGCACCGACCAGCAGACA-(UMI8-BC14)-ACCACCGCACGACCG pCCACGACCAGCCACGA-GSP>sDNA-Loop
3' dT-TGGTGGCGTGCTGGC--GGTGCTGGTCGGTGCT-A
            L1-L2linker
```

Amplicon Structure after 1ˢᵗ PCR step.

(SEQ ID NOs: 32 and 33)

```
                Anc1>                    L2-L1                    Fwd
AGCAGCACCGACCAGCAGACA-(UMI8-BC14-ACCACCGCACGACCGCCACGACCAGCCACGA-GSP>sDNA--GSP-TCTGTGCTGGTCGGTGCTCGT

TCGTCGTGGCTGGTCGTCTGT-(UMI8-BC14)-TGGTGGCGTGCTGGCGGTGCTGGTCGGTGCT-GSP>asDNA-GSP-AGACACGACCAGCCACGAGCA
         MB-Ind                                                         Rev         <Anc2
```

E. Second PCR

A 5-μl aliquot of the first PCR product produced as described in Step D, above, is combined with Multiplex DNA polymerase reaction mix (100-μl) and amplified using forward and reverse PCR primers (P7-Anc1 and P5-Anc2) for 8 cycles. The forward and reverse PCR primers (P7-Anc1 and P5-Anc2) primers have the following structure:

P7-Anc1

(SEQ ID NO: 34)

AGCAGAAGACGGCATACGAGATAGCAGCACCGACCAGCAGACA

P5-Anc2

(SEQ ID NO: 35)

ACGGCGACCACCGAGATCTACACACGAGCACCGACCAGCACAGA

The resultant amplicon composition is treated with ExoI (1-μl) at 37° C. for 30 min. This first PCR results in the production of sequencing adaptor containing sample-barcoded anchor-domain-flanked double-stranded gene specific deoxyribonucleic acid (DNA) fragments having the structure:

Amplicon structure after second PCR step.

(SEQ ID NOs: 36 and 37)

```
P7                                       Anc1
AGCAGAAGACGGCATACGAGATAGCAGCACCGACCAGCAGACA-(UM
              L2-L1                Fwd
I8)-BC14)ACCACCGCACGACCGCCACGACCAGCCACGA-GSP>sDNA-
--sDNA-GSP-TCTGTGCTGGTCGGTGCTCGTCGTGTGTAGATCTCGGTG
GTCGCCGT
```

-continued

```
TCGTCTTCTGCCGTATGCTCTATCGTCGTCGTGGCTGGTCGTCTGT-(UM
I8-BC14)TGGTGGCGTGCTGGCGGTGCTGGTCGGTGCTGSP>asDNA-a
sDNA-GSP-AGACACGACCAGCCACGAGCAGCACACATCTAGAGCCACCA
    Rev    Anc2
GCGGCA
```

The resultant adaptor containing sample-barcoded anchor-domain-flanked double-stranded gene specific deoxyribonucleic acid (DNA) fragments are analyzed by gel and combined at equal amount based on the smear analysis (220-480 bp range) and purified using AMPpure magnetic beads (1.8× volume, Beckman Coulter) according to the manufacturer's protocol.

The purified adaptor containing sample-barcoded anchor-domain-flanked double-stranded gene specific deoxyribonucleic acid (DNA) fragments are quantitated by OD260 measurement, and diluted to 10 nM (2.2 ng/μl) for next-generation sequencing in NextSeq500 Illumina platform using the following program: Read 1: RevSS-SeqDNA>34 cycles; Ind 1:RevSS-SeqInd>14 cycles; Ind 2: FwdSS-SeqMB>8 cycles; Read 2: FwdSS-SeqDNA>34 cycles. The sequencing primers have the following structure:

FwdSS-SeqDNA

(SEQ ID NO:38)

ACGACCGCCACGACCAGCCACGA

FwdSS-SeqMB

(SEQ ID NO 39)

ACGAGATAGCAGCACCGACCAGCAGACA

RevSS-SeqDNA

(SEQ ID NO: 40)

ACTACACACGAGCACCGACCAGCACAGA

RevSS-SeqInd

(SEQ ID NO:41)

TGGTCGTGGCGGTCGTGCGGTGGT

IV. Protocol Employing Sample Barcoded Reverse Gene Specific Primer

A. Design of Barcoded Reverse Gene Specific Primers.

(SEQ ID NO: 42, 43, and 84)

```
        3'       L2        5'3'  L1         Anchor 2        5'
      RevGSP-ACCGACCAGCACC;> GCCAGCACGCCA-(Barcode)-AGACACGACCAGCCACGAGCA-X-Bead A-TGGCTGGTCGTGG--CGGTCGTGCGGT-3'dT
                              Link1s
```

Barcoded oligonucleotides with minimum structure linker 5'-Anchor 2-Barcode-Linker L1-3' are ligated to reverse gene specific primer set (RevGSP) with minimum structure 5'-phosphate-Linker L2-RevGSP-3' using complementary to linker L1 and linker L2 oligonucleotide Link1s and DNA ligase under ligation conditions.

The DNA ligation reaction attaches barcoded anchor oligonucleotides to reverse gene specific primers. As a result of the ligation reaction, the set of reverse gene specific primers is labeled with specific barcode. The set of barcoded reverse gene specific primers is purified from non-ligated products and used in the disclosed primer extension assay. The same set of gene specific primers could be labeled with plurality of different barcodes using the same protocol. In another embodiment, the same protocol could be used for barcoding set of forward gene specific primers.

Barcode-Anchor oligonucleotides are attached to the solid surface (e.g. beads) through linker X (e.g. X could be a cleavable linker). Furthermore, the different binding moiety (e.g. antibodies) may be attached to the beads to provide binding of the antibody-bead-barcoded GSP complex to specific cell types through antigen-antibody interactions.

Importantly, each barcode could have a complex structure as described in the application in more detail. These complex composite barcodes could have several domains, including but not limited to:
1) Sample barcode—specific sequence (usually from 8-14 nt) attached to a set of gene-specific primers, to label all extension products derived from target RNA sample.
2) UMI—complex random, semi-random (usually 8-12 nt), or set of unique specific sequences which allow to label each molecule used in disclosed primer extension assay with unique sequence/barcode. UMI could be added to RevGSP-Linker 2 set between RevGSP and linker L2.
3) Bead barcode—specific sequence (10-16 nt) unique for each bead if gene-specific primers are attached to the beads. In some embodiments, e.g. for single cell analysis applications (e.g. if only one biological sample used in the assay) bead barcode could be sample barcode.
4) Antibody barcode—specific sequence unique for each specific antibody immobilized to the beads.

Linker L1, linker L2 and complementary Link1s could be designed with variety of different sequences with minimum length of 4 nt each.

Examples of Anchor 2-Barcode-Linker 1 Oligonucleotides Used in Ligation Reaction:

```
Barcodes are underlined
Anc2-BC1-L1
                                       (SEQ ID NO: 44)
ACGAGCACCGACCAGCACAGAGAACAAACACCGCACGACCG Anc2-BC2-L1
                                       (SEQ ID NO: 45)
ACGAGCACCGACCAGCACAGAGGCGAAACACCGCACGACCG Anc2-BC3-L1
                                       (SEQ ID NO: 46)
ACGAGCACCGACCAGCACAGAGCAAAGGACCGCACGACCG
```

Example of Bead-Barcoded Oligonucleotide Conjugates (Synthesized by Chemgenes, Inc.) Used in Ligation Reaction.

In the diagram below: T25—is oligo dT (25 nt) moiety used for binding to the beads and purification of hybridization complexes between target RNA and barcoded reverse gene specific primers; PClinker—photocleavable linker, or SSlinker—bisulfite linker cleaved by sulfite ions (e.g. DTT treatment) used for detachment of reverse barcoded gene specific primers from the beads; Anchor2—binding site for universal amplification primer; UMI—Unique molecular index; Barcode—sample-specific 6 nt barcode (underlined); Linker L2-sequence necessary for ligation of barcodes with gene specific primer set.

```
ChemB-T25-PC1-Anc2-BC-L2
                                       (SEQ ID NO: 48)
                      Anchor 2    UMI
Bead-linker-T25-PClinker-AGCACCGACCAGCACAGAVVNVVNVV Barcode Linker L2
CATCAGACCGCACGACCG-3'

ChemB-T25-SS-Anc2-BC-L2
                                       (SEQ ID NO: 50)
                      Anchor 2    UMI
Bead-linker-T25-SSlinker-AGCACCGACCAGCACAGAVVNVVNVV Barcode Linker L2
CAGCATGACCGCACGACCG-3'
```

Example of Final Barcoded Reverse Gene Specific Primer Structure Employed in the Assay

```
                                       (SEQ ID NO: 51)
3'            L2-L1
RevGSP-ACCGACCAGCACCGCCAGCACGCCA-(Barcode)-

Anchor2        5'
AGACACGACCAGCCACGAGCA
``` wherein, L2-L1 linker sequence generated by ligation of L1 and L2 linkers, Barcode—complex barcode, as described in a more details above, Anchor2—universal primer binding site. A similar structure could be generated for barcoded forward gene specific primer set and employed in the disclosed assay:

```
                                       (SEQ ID NO: 52)
3'            L2-L1
FwdGSP-ACCGACCAGCACCGCCAGCACGCCA-(Barcode)-

Anchor1        5'
ACAGACGACCAGCCACGACGA
```

In some embodiments, the barcoded reverse gene specific primer composition could be synthesized by combinatorial (pool and split) chemical synthesis without DNA ligation step. In this embodiment, L2-L1 linker will be missing in the final structure.

B. High-Throughput Synthetic Template and Calibration Control Template Oligonucleotide Synthesis Oligonucleotide libraries consisting of complex mixtures of oligonucleotides ranging in length from 150-250 base pairs were manufactured by Agilent Technologies under contract. Oligonucleotide design comprises full-length (or truncated in the middle) sequences of all amplicons flanked by gene specific primers, surrounding amplicon RNA sequences (for amplicons shorter than 200 bp) and two-point mutations downstream (4 nt) from the 3'-end of the each forward and reverse primer. In some embodiments, the oligonucleotides comprise the sequence of T7 promoter upstream of the forward primer binding site in order to generate sense synthetic template RNA that mimic natural target RNAs surrounding amplicon domains. Oligonucleotides were synthesized in spatially distinct locations using standard phosphoramidite chemistry on a silylated 6.625×6 inch wafer using an automated tool designed by Agilent Technologies. The solid support used in synthesis was a flat, non-porous silane coated glass rather than a locally curved, porous surface traditionally used. The coupling steps used inkjet-printing technologies to deliver the appropriate amount of activator and phosphoramidite monomer to specific spatial locations on the solid support under anhydrous conditions. Oxidation and detrytilation reactions were performed in dedicated flowcells using novel mechanical operations and fluid management steps to eliminate the depurination side reaction limiting synthesis of long oligonucleotides. After deprotection and release, oligonucleotides were recovered and concentrated by lyophilization in 2 mL tubes. Each Oligo Library yields 10 pmol of nucleic acid material equally divided among up to 55,000 user-defined, unique sequences. In another embodiment, the synthetic templates were synthesized using conventional phosphoramidate chemistry and mixed together at approximately equal concentration by IDT and MWG-Operon companies.

C. Calibration Control RNA Template Synthesis by Gene Assembly

The calibration control genes which mimic natural genes were synthesized by GeneScript Technologies using modified Gibson gene assembly protocol. In one embodiment, the calibration control genes comprising T7 promoter, full-length target mRNA sequences including amplicon domain with at least 1-2 point mutation downstream of primer binding site, and polyA (approximately 50 nt) were synthesized and cloned in the GeneScript vector, and clones were validated by Sanger sequencing. To generate a set of calibration control templates, plasmid DNA clones corresponding to the set of control genes were mixed together (or used separately), digested by NotI restriction enzyme at a site located downstream of polyA site. Furthermore, the linearized plasmids were used as templates for RNA synthesis using T7 RNA polymerase and the manufacturer's protocol (MonsterScript kit, Epicentre Technologies).

D. High-Throughput Gene Specific Primer Validation

Multiplex PCR primers with cognate target sequences were screened en masse. In some embodiments, the set of barcoded reverse gene specific primers (with the structure shown above) was first hybridized to control natural or synthetic template RNAs. Furthermore, the hybrids between target mRNA and barcoded reverse gene specific hybrids were combined together, purified and used as mix in the follow-up primer extension and amplification steps. In preferred embodiments, the hybridization step was performed with RNA sample and barcoded reverse gene specific primers in solution (e.g. primers released from beads). As discussed in a more detail above, the selection of primers with high hybridization efficiency and stability of target mRNA-primer complexes is the critical step which defines the overall performance of the assay and cross-talk between different samples. Moreover, using the barcoded reverse primers in the first step of protocol allows all samples to be combined together and therefore allows scale-up of the assay for analysis of hundreds-thousands of samples in single test tube format.

In another embodiment, the natural or synthetic template RNAs are reverse transcribed e.g., from random primer and synthesized cDNAs used as templates for the extension step, using barcoded forward gene specific primers and follow-up amplification steps.

In both protocols, uniformity of amplification, including primer efficiency, primer specificity and dynamic range (minimum 100-fold) were determined from multiplex reaction kinetic data. In order to reliably measure expression of different genes, the panel of 15 different human universal RNA from different commercial sources (Agilent, Clontech, BioChain, Qiagen, etc.) and synthetic template RNA were used as templates for cDNA synthesis. Non-specific primer activities were measured by yield of non-targeted products from human universal RNAs and negative control templates (human genomic DNA and mouse universal RNAs). The protocol for testing primer performance was repeated several times with sets of 3-5 PCR primer pairs per gene until the primers with high specific and low non-specific activity were selected. Finally, functionally validated primers were selected as experimentally validated primers for use in sets of experimental validated gene specific primers.

E. Multiplex RT-PCR Assay

1. Design of Primers for Anchor Addition, First and Second PCR Steps

Design of Barcoded Forward and Barcoded Reverse gene specific primers with anchor1 (Fwd-anchor1-GSP primers) and anchor2 (Rev-anchor2-GSP primers) with 3'-extended suppression portions for primer extension steps and universal PCR primers (F-MP1GAC and R-MP2CAG) to amplify anchored cDNA fragments by PCR.

Sequences that are underlined are the common PCR suppression portions, and those in italics and bold are unique sequences for forward or reverse primers, respectively. GSP is the gene-specific primer domain. The BC-Link is Barcode-Linker domain, which comprises the composite barcode as described in more details above and could be present in only reverse (preferred embodiment), only in forward or in both reverse and forward primers (SEQ ID NOS: 53 to 56).

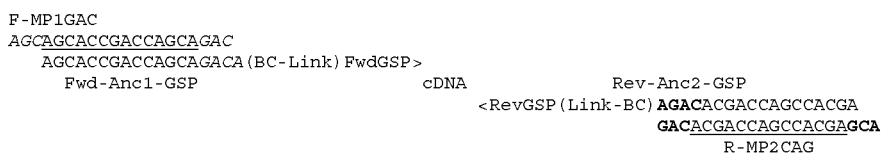

For simplicity, the structures below show the design of primers and amplification products only for the preferred embodiment of using barcoded reverse and non-barcoded forward gene specific primer set:

(SEQ ID NOS: 57 to 60)

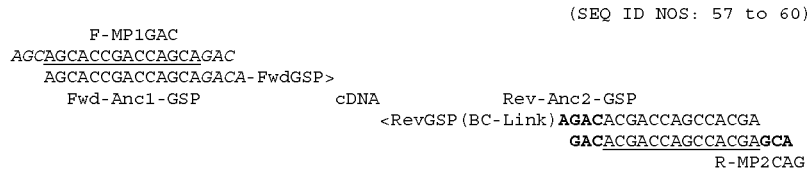

The resultant structure of amplified cDNA products after the two sequential primer extension steps using Barcoded Rev-anchor2-GSPs and Fwd-anchor1-GSPs and a first PCR step using universal F-MP1GAC and R-MP2CAG primers is shown below:

```
                              (SEQ ID NO: 61 and 62)
                                           (60-250nt)
AGCAGCACCGACCAGCAGACA-FwdGSP-cDNA-RevGSP-Link-BC-

TCTGTGCTGGTCGGTGCTCGT

TCGTCGTGGCTGGTCGTCTGT-FwdGSP-cDNA-RevGSP-Link-BC-

AGACACGACCAGCCACGAGCA
```

The first PCR amplified cDNA products were then subjected to a second round of PCR to add Illumina P7, P5 sequencing adaptors. PCR primers for the second PCR step comprise anchor 1 and anchor 2 binding domains, indexing (highlighted in red) domains (optional domains, can be used if experiment requires to combine the different samples together for NGS step) and P5 or P7 sequences necessary for cluster formation in Illumina NGS instrument, as illustrated below:

```
Set of Forward Indexing Primers for 2nd PCR step:
                                           (SEQ ID NOS: 63-68)
FP7-A1Ind-A
AGCAGAAGACGGCATACGAGATATACGACAGCAGCAGCACCGACCAGCAGACA FP7-A1Ind-B
AGCAGAAGACGGCATACGAGATACTGATGAGCAGCAGCACCGACCAGCAGACA FP7-A1Ind-C
AGCAGAAGACGGCATACGAGATAGCATCAAGCAGCAGCACCGACCAGCAGACA FP7-A1Ind-D
AGCAGAAGACGGCATACGAGATAAGTCGTAGCAGCAGCACCGACCAGCAGACA FP7-A1Ind-E
AGCAGAAGACGGCATACGAGATATCGCATAGCAGCAGCACCGACCAGCAGACA FP7-A1Ind-F
AGCAGAAGACGGCATACGAGATACATAGCAGCAGCAGCACCGACCAGCAGACA Set of Reverse Indexing Primers for 2nd PCR step:
                                           (SEQ ID NOS: 69-74)
RP5-A2Ind-A
ACGGCGACCACCGAGATCTACACATACGACACGACGAGCACCGACCAGCACAGA RP5-A2Ind-B
ACGGCGACCACCGAGATCTACACACTGATGACGACGAGCACCGACCAGCACAGA RP5-A2Ind-C
ACGGCGACCACCGAGATCTACACAGCATCAACGACGAGCACCGACCAGCACAGA RP5-A2Ind-D
ACGGCGACCACCGAGATCTACACAAGTCGTACGACGAGCACCGACCAGCACAGA RP5-A2Ind-E
ACGGCGACCACCGAGATCTACACATCGCATACGACGAGCACCGACCAGCACAGA RP5-A2Ind-F
ACGGCGACCACCGAGATCTACACACATAGCACGACGAGCACCGACCAGCACAGA Set of Forward and Reverse Non-indexing Primers for
2nd PCR step:
                                           (SEQ ID NOS: 75-76)
FP7-A1
AGCAGAAGACGGCATACGAGATAGCAGCAGCACCGACCAGCAGACA

RP5-A2
AGGGCGACCACCGAGATCTACACACGACGAGCACCGACCAGCACAGA
```

After a second PCR step with Forward and Reverse indexing primers the final amplicon structure, flanked with P7 and P5 Illumina's adaptor sequences and ready for NGS, is shown below:

```
                                           (SEQ ID NOS: 77-78)
P7(Ind)AGCAGCACCGACCAGCAGACA-FwdGSP-cDNA-RevGSP (LinkBC)TCTGTGCTGGTCGGTGCTCGT(Ind)P5

P7(Ind)TCGTCGTGGCTGGTCGTCTGT-FwdGSP-cDNA-RevGSP (LinkBC)AGACACGACCAGCCACGAGCA(Ind)P5
```

The sequences of primers for NGS sequencing (e.g. Illumina NextSeq500 platform) of cDNA inserts, barcode domain and indexes are provided below:

```
SeqDNAlink-Rev
                                  (SEQ ID NO: 79)
TGGCGTGCTGGCGGTGCTGGTCGGT SeqDNA-Fwd
                                  (SEQ ID NO: 80)
AGCAGCAGCACCGACCAGCAGACA SeqBarcode-Fwd
                                  (SEQ ID NO: 81)
ACCGACCAGCACCGCCAGCACGCCA Optional sequencing primers:
SeqIND-Fwd
                                  (SEQ ID NO: 82)
TCTGTGCTGGTCGGTGCTCGTCGT SeqIND-Rev
                                  (SEQ ID NO: 82)
TGTCTGCTGGTCGGTGCTGCTGCT SeqDNA-Rev
                                  (SEQ ID NO: 83)
ACGACGAGCACCGACCAGCACAGA
```

An example protocol for NGS sequencing of amplified cDNA products in Next Seq500 machine using 150-nt sequencing kit is shown below:
Read 1: SeqDNAlink-Rev>81 cycles
Ind 1: SeqIND-Rev>6 cycles
Ind 2: SeqBarcode-Fwd>38 cycles
Read 2: SeqDNA-Fwd>35 cycles The read number for SeqBarcode-Fwd primer could depend on the design of the specific barcode domain cassette. The read cycle number 38 was selected for reading complex sample barcode domain with the structure: Antibody barcode(6)-Sample barcode(6)-Bead barcode(14)-UMI(12).

F. Protocol for Multiplex RT-PCR amplification of target genes for expression profiling or mutation analysis starting from total RNA (1 ng-50 ng) mixed with calibration control RNA templates and using barcoded forward gene specific primer set.

Step 1. Total RNAs (mixed with synthetic calibration control RNA templates in a separate wells) was converted to cDNA in 10-μl of reaction mix using random primer (N6, 5 uM), 1×GC buffer, dNTP (500 uM) and Maxima Reverse Transcriptase (10 units, Thermo-Fisher) at 50° C. for 30 min.

Step 2. cDNA was primed (adding universal anchors 1 and barcodes) using a mix of Barcoded Forward-anchor1-GSP primers (5 nM final concentration for each primer) in 20-ul reaction mix comprising 1×GC buffer, dNTP (250 uM) and Phusion II (4 units, Thermo-Fisher) for 1 cycles at (98° C. for 1 min, 64° C. for 30 min).

Step 3. Barcoded cDNA products after first primer extension step were combined together and purified using an equal volume of AMPure magnetic beads (Beckman-Coulter) using manufacturer's protocol. Eluted cDNA (20 ul) was treated with exonuclease I (20 units, New England BioLabs) at 37° C. for 30-min.

Step 4. The Barcoded DNA products generated in step 3, were further extended (add universal anchor 2) using mix of Reverse-anchor2-GSPs in 25-ul reaction mix comprising 1×GC buffer, dNTP (250 uM) and Phusion II (5 units, Thermo-Fisher) for 1 cycles at (98° C. for 1 min, 64° C. for 30 min) and treated with exonuclease I (20 units) at 37° C. for 30-min.

Step 5. 1$^{st}$ PCR step. Whole volume (25-μl) of barcoded anchored cDNA fragments (from Step 4) were amplified in 75-μl reaction mix comprising 1×HF Buffer, dNTP (200 uM), universal PCR primers F-MP1GAC and R-MP2CAG and Phusion II (15 units, Thermo-Fisher) for 8-20 cycles (50 ng-1 ug of starting RNA, respectively) at (98° C. for 10 sec, 72° C. for 20 sec).

Step 6. 2$^{nd}$ PCR step. 5-μl aliquot of 1st PCR was amplified in 100-μl of PCR mix comprising 1×HF Buffer, dNTP (200 μM), indexed (specific for the each of several samples) or non-indexed (only for one sample) forward and reverse PCR primers and Phusion II (20 units, Thermo-Fisher) for 7 cycles at (98° C. for 10 sec, 72° C. for 20 sec).

Step 7. The amplified PCR products were analyzed in 3.5% agarose-1×TAE gel to optimize the cycle number and finally digested with exonuclease I (20 units, New England Biolabs), incubated and 37° C. for 30 min, inactivated at 65° C. for 15 min and purified by Qia PCR column. Purified PCR products were quantitated by Qubit (Thermo-Fisher) and if necessary different samples were mixed together (at an equal amount), diluted to 10 nM and sequenced in NextSeq500 using Illumina paired-end protocol and reagents for 150 cycles.

G. Protocol for Multiplex RT-PCR Amplification of Target Genes for Expression Profiling or Mutation Analysis in Single Cells Using Barcoded Reverse Gene Specific Primer Set.

Step 1. Individual cells (5,000-10,000) were deposited by FACS in a separate wells (or as a separate droplets in oil) or partitioned in microdroplets using a microfluidics instrument (MissionBio) together with the barcoded reverse gene specific primer set immobilized on beads through photocleavable linkers (ChemB-T25-PCI-Anc2-BC-L2, Chem-Genes, see structure above) in 1×TCL lysis-hybridization buffer (Qiagen) together with calibration control RNA template set.

Step 2. Barcoded reverse gene specific primers were released from beads by UV365 nm treatment (20 watts) for 5 minutes and hybridized with target RNA templates (present in lysates in a separate compartments) at 60° C. for 30 min. The hybridized complexes between the target RNA and the barcoded reverse gene specific primers were combined together (after removal of the oil phase for microdroplets) and purified bound to oligo dT25-beads by washing the beads three times in 1×SSC buffer. The purified target RNA-Barcoded reverse gene specific primer complexes were treated with thermosensitive exonuclease I (20 units, New England BioLabs) in 20-μl of 1×GC buffer at 37° C. for 30-min, 50° C. for 5 min. In an alternative protocol, the hybridized complexes between the target RNA and the barcoded reverse gene specific primers were combined together (after removal of the oil phase for microdroplets), purified using RNA/DNA micro kit (Qiagen) and treated with thermosensitive exonuclease I.

Step 3. Reverse primer extension step. RNA was converted to cDNA from barcoded reverse gene specific primers (hybridized to target RNA in Step 2) in 40-μl of reaction mix comprising 1×GC buffer, dNTP (500 uM), ThermaStop-RT (80 units, ThermaGenix) and Maxima Reverse Transcriptase (400 units, Thermo-Fisher) at 55° C. for 30 min.

Step 4. Forward primer extension step. Barcoded cDNA (generated in Step 3) was primed using a mix of Forward-anchor1-GSP primers (5 nM final concentration for the each primer) in 50-ul reaction mix comprising 1×GC buffer, dNTP (250 uM) and Phusion II (10 units, Thermo-Fisher) for 1 cycles at (98° C. for 1 min, 64° C. for 30 min) and treated with exonuclease I (20 units) at 37° C. for 30-min.

Step 5. 1$^{st}$ PCR step. The whole volume (50-μl) of barcoded anchored cDNA fragments (from Step 4) was amplified in 100-μl reaction mix comprising 1×HF Buffer, dNTP (200 uM), universal PCR primers F-MP1GAC and R-MP2CAG and Phusion II (20 units, Thermo-Fisher) for 14 cycles at (98° C. for 10 sec, 72° C. for 20 sec).

Step 6. $2^{nd}$ PCR step. A 5-µl aliquot of 1st PCR was amplified in 100-µl of PCR mix comprising 1×HF Buffer, dNTP (200 µM), indexed (specific for the each of several samples) or non-indexed (only for one sample) Fwd and Rev PCR primers and Phusion II (20 units, Thermo-Fisher) for 7 cycles at (98° C. for 10 sec, 72° C. for 20 sec).

Step 7. The amplified PCR products were analyzed in 3.5% agarose-1×TAE gel to optimize the cycle number and finally digested with exonuclease I (20 units, New England Biolabs), incubated and 37° C. for 30 min, inactivated at 65° C. for 15 min and purified by AMPure beads (1.5× volume) using manufacturer's protocol (Beckman-Coulter). Purified PCR products were quantitated by Qubit (Thermo-Fisher) and if necessary different samples were mixed together (at equal amount), diluted to 10 nM and sequenced in Next-Seq500 using Illumina paired-end protocol and reagents for 150 cycles.

H. Next Generation Sequencing Applications

Recently developed targeted approaches reduce NGS data complexity and generate qualitative sequencing information by measurement of a subset of targets per technical replicate with minimal sample usage. Nonetheless, targeted approaches reported thus far have limited clinical utility due to several scientific challenges, such as a priori determining which genetic markers have the most clinical significance and identifying key genetic variants that are correlated with a specific drug response. Furthermore, technical limitations due to skewed or inaccurate quantitative representation of clinical targets and inter-library variation confound their utility in the clinical setting.

For example, cancer is a complex multigenic disease characterized by diverse genetic and epigenetic alterations. A comprehensive catalog of all types of variants in cancer opens novel and unique opportunities for understanding the mechanism of cancer onset or progression and facilitates a more personalized approach to clinical care, including improved risk stratification and treatment selection. Next-generation sequencing (NGS) is now a major driver in translational and genetic research, providing a powerful way to study DNA or RNA from clinical specimens. For example, transcriptome profiling can unambiguously define a unique gene expression signature for each tumor that may prove useful for both disease classification and prognosis. Unfortunately, both the cost and the complexity of whole genome DNA sequencing or transcriptome RNA-sequencing data sets impede the use of these methodologies in routine molecular diagnostic testing.

Predesigned targeted gene panels disclosed in the current invention contain essential genes associated with human disease or phenotype(s), selected from publications, open access databases/resources, and expert curation. By focusing on the genes most likely to be involved in cellular processes and disease, these targeted RNA-Seq panels conserve sequencing next-generation sequencing (NGS) resources and minimize data analysis considerations. Predesigned panels will be unique experimental tools for clinical research on various diseases, such as cancer, signaling pathways, markers of cell lineage, differentiation, and activation. Examples below illustrate several assays we developed for clinical research applications.

1. Cell Marker Panel Assay for Profiling Cell Composition

The human Cell Marker Assay is a targeted multiplex RT-PCR panel that enables gene signature-based inference and quantitative evaluation of multiple unique immune and stromal cell types. The Cell Marker Assay provides a cost-effective strategy for quantitative analysis of cell composition in a wide range of clinical samples based on analysis of all well-characterized cell specific biomarkers.

The cell marker gene sets summarize and characterize gene signatures for 64 distinct cell types, spanning multiple adaptive and innate immunity cells, hematopoietic progenitors, epithelial cells, and extracellular matrix cells derived from thousands of published gene expression signatures. To generate our compendium of gene-specific signatures for human cell types, we used data from ENCODE, FANTOM, ImmGen, and the Human Primary Cells Atlas (HPCA). Also, we collected gene expression profiles from the Blueprint project, from which we annotated 144 samples from 28 cell types, and the IRIS project, from which we annotated 95 samples from 13 cell types. We collected and curated gene expression profiles from ~2,310 samples of pure cell types and annotated 64 distinct cell types and cell subsets.

The Human Cell Marker 1.3K targeted panel measures the expression level of 1,285 human protein-coding genes by combining highly multiplexed RT-PCR amplification with the depth and precision of NGS quantitation. The Cell Marker 1.3K panel also includes a set of 85 housekeeping genes with constant expression between different cell types. The Cell Marker 1.3K panel employs computationally-predicted set of PCR primers for multiplex PCR which are functionally (i.e., experimentally) validated, e.g., as described above. The unique multiplex primer design minimizes primer dimerization and cross-reactivity while enhancing specificity of hybridization and efficacy in primer extension steps. The set of calibration control RNA templates was developed for all housekeeping and 1285 cell marker genes, and is mixed with sample template RNA to be used as internal standards for calibration and QC of all RNA samples employed in the assay. It is an easy-to-run, one-tube assay that can be run directly from cell extract or total RNA (10 pg-50 ng) isolated from cells, tissues, or blood. In this embodiment, the RNA template compositions from different samples are hybridized with set of barcoded reverse gene specific primers, the RNA-primer hybrids are combined together in single-test tube, purified from non-bind primers, and used for follow-up primer extension and amplification steps. The multiplex single-tube assay provides robust, quantitative, and reproducible measurements of each expressed gene in the set of biological samples over as much as 5-orders of magnitude differences in expression level.

In another embodiment, the reverse gene specific primer set is immobilized to barcoded beads (one specific barcode per bead) through a cleavable linker. The barcoded bead-gene specific primer conjugates are mixed with the set of individual cells from a cell sample together with calibration control RNAs. One bead-one cell compositions are then isolated in separate compartments by FACS, aliquoting or microdroplet technology. The hybridization of detached barcoded gene specific primers with target mRNAs in solution, combining of all samples together, extension of purified of RNA-gene specific primer hybrids and follow up RT-PCR-NGS protocol allows a high level of multiplexing in analysis of thousands of individual cells. Moreover, single cell analysis combined with calibration control templates allows quality control analysis of each individual cell, plus normalization and calibration of the single cell data.

As to utility, the generated normalized quantitative single cell data could be used to accurately profile the specific cell composition in a wide range of clinical samples, including blood, tissue, biological fluids, organoids, isolated cells, organs, etc. in normal, treated, and disease states. The comprehensive set of cell type specific markers included in the assay allows robust and cost-effective cell typing analysis even at the scale of hundreds of thousands of individual cells. Moreover, Cell Marker 1.3K assay provides a cost-effective strategy for the discovery of novel diagnostic and prognostic cell types and cell specific biomarkers in xenograft, fine needle aspirate (FNA), biopsy, blood, and circulating tumor cell (CTC) clinical samples. Currently, an extended panel of cell markers based on the most recent public data are in development to address specific disease areas.

2. Blood Biomarker Diagnostic Panel

There is ample evidence that development of novel prognostic and predictive biomarkers is a critical step for selecting patients predisposed to respond to existing and novel (e.g. immunotherapy) treatments and their combinations. The Blood Biomarker 10K assay (BB10K) allows one to dissect immunological response mechanisms and discover novel prognostic and predictive immune response gene signatures.

The BB10K assay was developed to quantitatively profile expression of 10,000 key immunity genes expressed in different types of blood cells, using, in the preferred embodiment, single-cell multiplex RT-PCR amplification from total RNA followed by NGS sequencing. The individual cells (10K-100K) from peripheral blood mononuclear cell (PBMC) samples were mixed with cell type-specific antibody-bead-barcoded reverse gene specific primer conjugate and sorted by FACS or microfluidic technologies in separate droplets (compartments) for cell-specific barcoding of target mRNAs directly in cell lysates. Furthermore, each specific bead-antibody conjugate could be optically encoded to facilitate isolation and analysis e.g. by FACS specific single cell-bead conjugates. No mRNA enrichment, beta-globin depletion, or other processing are required. Up to 100 PBMC clinical samples could be run and combined together in the assay to provide a high level of multiplexing and significantly reduce sample-to-sample variation and batch effect issues. Furthermore, the built-in internal calibration standards allow calibration and adjusting of digital HT sequencing data depending on the level of intrinsic noise and quality of samples. The BB10K assay provides quantitative expression data of immune-related genes with 1,000-fold dynamic range and sensitivity down to 10 copies of RNA per cell in whole cell lysate or cell fractions (e.g. nucleus) from frozen PBMC clinical samples. Up to 100 PBMC clinical samples could be run and combined together (after hybridization step) in the assay to provide high level of multiplexing and significantly reduce sample-to-sample variation and batch effect issues.

The BB10K panel includes more than 100 experimentally validated core gene signatures (e.g., based on immunity HallMark database, Broad Institute) which correlate with a wide range of pathological conditions (cancer, cardiovascular, infection, acute pain, etc.), and predict efficacy of immunotherapy in several cancer types, including melanoma, colorectal, breast, and lung cancers after stimulation in vitro or in vivo by drugs, physical treatment, biologics or chemical compounds (heat shock, LPS, bacterial antigens, etc.). Furthermore, the core signatures were expanded by developing a computational functional interaction network model to predict key nodes in pathways specific for antigen presentation and recognition, inhibition and activation of immune cells. The BB10K panel also includes a set of TCR and BCR genes (variable regions) and housekeeping genes with constant expression between different blood cell types. The set of calibration control RNA templates was developed for all housekeeping and 1000 different blood cell type-specific genes in order to use as internal standards for calibration and QC of all cells employed in the assay.

Single cell expression profiling in all main blood cell types with the BB10K gene panel enables researchers to discover prognostic and predictive immune response biomarker signatures. The predictive signatures have the potential to stratify patients with a wide range of clinical indications for responses to the growing number of therapeutic treatments.

Notwithstanding the appended claims, the disclosure is also defined by the following clauses:

1. A method of preparing a plurality of sample-barcoded anchor-domain-flanked gene specific deoxyribonucleic acid (DNA) fragments from a template ribonucleic acid (RNA) sample, the method comprising:

employing a set of gene specific primer (GSP) pairs to produce the plurality of sample-barcoded anchor-domain-flanked gene specific DNA fragments from the template RNA sample, wherein each pair of gene specific primers (GSPs) is made up of an anchor domain comprising forward primer and an anchor domain comprising reverse primer, at least one of which comprises a sample barcode domain.

2. The method according to Clause 1, wherein each pair of the set of GSPs is made up of a forward primer comprising an anchor domain and a reverse primer comprising an anchor domain and a sample barcode domain.

3. The method according to Clause 2, wherein the method comprises contacting the template RNA sample with the reverse primers of the set to produce a hybrid composition comprising RNA/anchored sample barcoded reverse primer hybrids.

4. The method according to Clause 2, wherein the reverse primers are linked to a solid support.

5. The method according to Clause 4, wherein the solid support is a bead.

6. The method according to Clauses 4 and 5, wherein the reverse primers are linked to the solid support by a cleavable linker.

7. The method according to any of Clauses 3 to 6, wherein the method comprises removing unbound reverse primers from the hybrid composition to produce a hybrid enriched composition.

8. The method according to Clause 7, wherein the method comprises contacting the hybrid enriched composition with the forward primers of the set under primer extension reaction conditions to produce the plurality of sample-barcoded anchor-domain-flanked gene specific DNA fragments from the template RNA.

9. The method according to Clause 1, wherein the method comprises employing a sample-barcoded donor nucleic acid comprising an anchor domain and a sample barcode domain to produce the set of GSPs.

10. The method according to Clause 9, wherein the sample-barcoded donor nucleic acid comprises an RNA capture domain.

11. The method according to Clause 10, wherein the sample-barcoded donor nucleic acid further comprises a first linker, either the forward primers or the reverse primers comprise a second linker and the method further comprises ligating the first and second linkers.

12. The method according to any of Clauses 9 to 11, wherein the sample-barcoded donor nucleic acid comprises the structure: 3'-linker 1-sample barcode domain-anchor 2 domain-RNA binding domain-5'.

13. The method according to Clause 12, wherein the reverse primers comprise the structure: 3'-reverse GSP domain-linker 2-5'; and the forward primers comprise the structure 5'-anchor 1-forward GSP domain-3'.

14. The method according to Clause 13, wherein the method comprises:

contacting the template RNA sample with the sample-barcoded donor nucleic acid and the reverse primers under hybridization conditions;

ligating the linker 1 and linker 2 domains of hybrid sample-barcoded donor nucleic acid and reverse primers to produce sample-barcoded reverse primers;

reverse transcribing first strand complementary DNA (cDNA) molecules from the sample-barcoded reverse primers; and contacting the first strand cDNA molecules with the forward primers under polymerase mediated primer extension reaction conditions to produce the plurality of sample-barcoded anchor-domain-flanked gene specific DNA fragments from the RNA sample.

15. The method according to any of Clauses 9 to 11, wherein the sample-barcoded donor nucleic acid comprises the structure: 3'-RNA binding domain-anchor 1 domain-sample barcode domain-linker 1 domain-5'.

16. The method according to Clause 15, wherein the forward primers comprise the structure: 3'-forward GSP domain-linker 2-5'; and the reverse primers comprise the structure 5'-anchor 2-reverse GSP domain-3'.

17. The method according to Clause 16, wherein the method comprises:

contacting the template RNA sample with the sample-barcoded donor nucleic acid under conditions sufficient to reverse transcribe first strand cDNA molecules from the template RNA sample;

contacting the first strand cDNA molecules with the forward primers under polymerase mediated primer extension reaction conditions sufficient to produce second strand cDNA molecules comprising a 5' linker 2 domain and a 3' linker 1 domain;

ligating the 5' linker 1 domain to the 3' linker 2 domain to circularize the second strand cDNA molecules; and contacting the circularized second strand cDNA molecules with the reverse primers to produce the plurality of sample-barcoded anchor-domain-flanked gene specific DNA fragments from the template RNA sample.

18. The method according to any of the preceding clauses, wherein the forward and reverse primers of each primer pair comprise gene specific (GSP) domains that are experimentally validated as suitable for use in a multiplex amplification assay.

19. The method according to any of the preceding clauses, wherein the forward and reverse primers of each primer pair are separated by a template distance of 60 to 300 nt.

20. The method according to any of the preceding clauses, wherein the template ribonucleic acid sample comprises messenger ribonucleic acids (mRNAs).

21. The method according to any of the preceding clauses, wherein the template RNA sample is obtained from a single cell.

22. The method according to Clause 21, wherein the method comprises obtaining the template RNA sample by isolating the single cell and then lysing the isolated single cell to produce the RNA sample.

23. The method according any of the preceding clauses, wherein the GSP domain of each forward primer ranges in length from 18 to 25 nt.

24. The method according any of the preceding clauses, wherein the GSP domain of each reverse primer ranges in length from 30 to 70 nt.

25. The method according to any of the preceding clauses, wherein the flanking anchor domains comprise a universal priming site and the method further comprises amplifying the primer extension products comprising the anchor domains with universal forward and reverse primers having sequences complementary to the universal priming sites under amplification conditions sufficient to produce a barcoded amplicon composition comprising multiple product amplicons.

26. The method according to Clause 25, wherein the universal forward and reverse primers further comprise Next-Generation Sequencing (NGS) adaptor domains.

27. The method according to Clause 26, wherein the method further comprises adding NGS adaptor domains to the multiple product amplicons of the barcoded amplicon composition 28. The method according Clause 27, wherein the NGS adaptor domains are added to the multiple product amplicons of the barcoded amplicon composition via an amplification protocol.

29. The method according to any of Clauses 25 to 28, wherein the method further comprises sequencing the multiple product amplicons.

30. The method according to Clause 29, wherein the multiple product amplicons are sequenced using an NGS protocol.

31. The method according to any of the preceding clauses, wherein the method is performed in a well.

32. The method according to any of Clauses 1 to 30, wherein the method is performed in a droplet.

33. The method according to Clause 32, wherein the droplet is produced using a microfluidics protocol.

34. The method according to Clause 32, wherein the droplet is producing using a fluorescence activated cell sorter (FACS) protocol.

35. The method according to any of the preceding clauses, wherein the method comprises a pooling step.

36. The method according to any of the preceding clauses, wherein the method comprises employing a calibration ribonucleic acid composition.

37. A method of preparing a plurality of sample-barcoded anchor-domain-flanked gene specific DNA fragments from a template RNA sample, the method comprising:

contacting the template RNA sample with reverse primers of a set of GSPs, wherein the reverse primers comprise an anchor domain and a sample barcode domain, to produce a hybrid composition comprising RNA/anchored sample barcoded reverse primer hybrids;

removing unbound reverse primers from the hybrid composition to produce a hybrid enriched composition;

reverse transcribing the hybrid enriched composition to produce a cDNA composition; and contacting the cDNA composition with forward primers of the set, wherein the forward primers comprise an anchor domain, under primer extension reaction conditions to produce the plurality of sample-barcoded anchor-domain-flanked gene specific DNA fragments from the template RNA sample.

38. The method according to Clause 37, wherein the reverse primers further comprise a UMI domain.

39. The method according to Clause 37, wherein the reverse primers are linked to a solid support.

40. The method according to Clause 39, wherein the solid support is a bead.

41. The method according to Clauses 39 and 40, wherein the reverse primers are linked to the solid support by a cleavable linker.

42. The method according to Clause 41, wherein the method further comprises cleaving the cleavable linker.

43. The method according to any of Clauses 39 to 42, wherein the solid support further comprises specific binding pair member.

44. The method according to Clause 43, wherein the specific binding pair member specifically binds to a cell surface marker.

45. The method according to any of Clauses 39 to 44, wherein the reverse primers further comprise a solid support barcode domain.

46. The method according to any of Clauses 37 to 45, wherein the template RNA sample is obtained from a single cell.

47. The method according to Clause 46, wherein the method comprises obtaining the template RNA sample by isolating the single cell and then lysing the isolated single cell to produce the template RNA sample.

48. The method according to Clause 47, wherein the cell is isolated and lysed in a well.

49. The method according to Clause 47, wherein the cell is isolated and lysed in a droplet.

50. The method according to Clause 49, wherein the droplet is produced using a microfluidics protocol.

51. The method according to Clause 49, wherein the droplet is producing using a fluorescence activated cell sorter (FACS) protocol.

52. The method according to any of Clauses 37 to 51, wherein the method comprises a pooling step.

53. The method according to Clause 52, wherein the pooling step comprises pooling the enriched hybrid composition with at least one additional enriched hybrid composition produced form at least one additional template RNA sample.

54. The method according to any of Clauses 37 to 53, wherein the method comprises employing a calibration ribonucleic acid composition.

55. The method according to any of Clauses 37 to 54, wherein the method further comprises removing non-extended forward primers from the plurality of sample-barcoded anchor-domain-flanked gene specific DNA fragments.

56. The method according any of Clauses 37 to 55, wherein the GSP domain of each forward primer ranges in length from 18 to 25 nt.

57. The method according any of Clauses 37 to 56, wherein the GSP domain of each reverse primer ranges in length from 30 to 70 nt.

58. The method according to any of Clauses 37 to 57, wherein the flanking anchor domains comprise a universal priming site and the method further comprises amplifying the primer extension products comprising the anchor domains with universal forward and reverse primers having sequences complementary to the universal priming sites under amplification conditions sufficient to produce a barcoded amplicon composition comprising multiple product amplicons.

59. The method according to Clause 58, wherein the universal forward and reverse primers further comprise Next-Generation Sequencing (NGS) adaptor domains.

60. The method according to Clause 59, wherein the method further comprises adding NGS adaptor domains to the multiple product amplicons of the barcoded amplicon composition.

61. The method according Clause 60, wherein the NGS adaptor domains are added to the multiple product amplicons of the barcoded amplicon composition via an amplification protocol.

62. The method according to any of Clauses 58 to 61, wherein the method further comprises sequencing the multiple product amplicons.

63. The method according to Clause 62, wherein the multiple product amplicons are sequenced using an NGS protocol.

64. A system comprising:
   nucleic acid amplification device;
   a sample-barcoded donor nucleic acid comprising a RNA binding domain, an anchor domain and a sample barcode domain; and
   a set of GSPs wherein each pair of GSPs is made up of a forward primer and a reverse primer.

65. The system according to Clause 64, wherein the sample-barcoded donor nucleic acid further comprises a first linker and either the forward primers or the reverse primers comprise a second linker.

66. The system according to Clause 65, wherein the sample-barcoded donor nucleic acid comprises the structure: 3'-linker 1-sample barcode domain-anchor 2 domain-RNA binding domain-5'.

67. The system according to Clause 66, wherein the reverse primers comprise the structure: 3'-reverse GSP domain-linker 2-5'; and the forward primers comprise the structure 5'-anchor 1-forward GSP domain-3'.

68. The system according to Clause 67, wherein the sample-barcoded donor nucleic acid comprises the structure: 3'-RNA binding domain-anchor 1 domain-sample barcode domain-linker 1 domain-5'.

69. The system according to Clause 68, wherein the forward primers comprise the structure: 3'-forward GSP domain-linker 2-5'; and the reverse primers comprise the structure 5'-anchor 2-reverse GSP domain-3'.

70. The system according to any of Clauses 64 to 69, wherein the forward and reverse primers of each primer pair comprise GSP domains that are experimentally validated as suitable for use in a multiplex amplification assay.

71. The system according to any of Clauses 64 to 70, wherein the forward and reverse primers are separated by a template distance of 60 to 300 nt.

72. The system according to any of Clauses 64 to 71, wherein the system further comprises a RNA sample.

73. The system according to Clause 72, wherein the RNA sample is from a single cell.

74. The system according to any of Clauses 64 to 73, wherein the device is a thermal cycler.

75. A system comprising:
   nucleic acid amplification device; and
   a set of GSPs wherein each pair of GSPs is made up of a forward primer and a reverse primer comprising a sample barcode domain.

76. The system according to Clause 75, wherein the forward and reverse primers of each primer pair comprise GSP domains that are experimentally validated as suitable for use in a multiplex amplification assay.

77. The system according to any of Clauses 75 to 76, wherein the forward and reverse primers are separated by a template distance of 60 to 300 nt.

78. The system according to any of Clauses 75 to 77, wherein the reverse primers are linked to a solid support.

79. The system according to Clause 78, wherein the solid support is a bead.

80. The system according to any of Clauses 78 to 79, wherein the reverse primers are linked to the solid support by a cleavable linker.

81. The system according to any of Clauses 78 to 80, wherein the solid support further comprises specific binding pair member.

82. The system according to Clause 81, wherein the specific binding pair member specifically binds to a cell surface marker.

83. The system according to any of Clauses 78 to 82, wherein reverse primers further comprise a solid support barcode domain.

84. The system according to any of Clauses 75 to 83, wherein the system further comprises a RNA sample.

85. The system according to Clause 84, wherein the RNA sample is from a single cell.

86. The system according to any of Clauses 75 to 85, wherein the device is a thermal cycler.

In at least some of the previously described embodiments, one or more elements used in an embodiment can interchangeably be used in another embodiment unless such a replacement is not technically feasible. It will be appreciated by those skilled in the art that various other omissions, additions and modifications may be made to the methods and structures described above without departing from the scope of the claimed subject matter. All such modifications and changes are intended to fall within the scope of the subject matter, as defined by the appended claims.

It will be understood by those within the art that, in general, terms used herein, and especially in the appended claims (e.g., bodies of the appended claims) are generally intended as "open" terms (e.g., the term "including" should be interpreted as "including but not limited to," the term "having" should be interpreted as "having at least," the term "includes" should be interpreted as "includes but is not limited to," etc.). It will be further understood by those within the art that if a specific number of an introduced claim recitation is intended, such an intent will be explicitly recited in the claim, and in the absence of such recitation no such intent is present. For example, as an aid to understanding, the following appended claims may contain usage of the introductory phrases "at least one" and "one or more" to introduce claim recitations. However, the use of such phrases should not be construed to imply that the introduction of a claim recitation by the indefinite articles "a" or "an" limits any particular claim containing such introduced claim recitation to embodiments containing only one such recitation, even when the same claim includes the introductory phrases "one or more" or "at least one" and indefinite articles such as "a" or "an" (e.g., "a" and/or "an" should be interpreted to mean "at least one" or "one or more"); the same holds true for the use of definite articles used to introduce claim recitations. In addition, even if a specific number of an introduced claim recitation is explicitly recited, those skilled in the art will recognize that such recitation should be interpreted to mean at least the recited number (e.g., the bare recitation of "two recitations," without other modifiers, means at least two recitations, or two or more recitations). Furthermore, in those instances where a convention analogous to "at least one of A, B, and C, etc." is used, in general such a construction is intended in the sense one having skill in the art would understand the convention (e.g., "a system having at least one of A, B, and C" would include but not be limited to systems that have A alone, B alone, C alone, A and B together, A and C together, B and C together, and/or A, B, and C together, etc.). In those instances where a convention analogous to "at least one of A, B, or C, etc." is used, in general such a construction is intended in the sense one having skill in the art would understand the convention (e.g., "a system having at least one of A, B, or C" would include but not be limited to systems that have A alone, B alone, C alone, A and B together, A and C together, B and C together, and/or A, B, and C together, etc.). It will be further understood by those within the art that virtually any disjunctive word and/or phrase presenting two or more alternative terms, whether in the description, claims, or drawings, should be understood to contemplate the possibilities of including one of the terms, either of the terms, or both terms. For example, the phrase "A or B" will be understood to include the possibilities of "A" or "B" or "A and B."

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, such as in terms of providing a written description, all ranges disclosed herein also encompass any and all possible sub-ranges and combinations of sub-ranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like include the number recited and refer to ranges which can be subsequently broken down into sub-ranges as discussed above. Finally, as will be understood by one skilled in the art, a range includes each individual member. Thus, for example, a group having 1-3 articles refers to groups having 1, 2, or 3 articles. Similarly, a group having 1-5 articles refers to groups having 1, 2, 3, 4, or 5 articles, and so forth.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

Accordingly, the preceding merely illustrates the principles of the invention. It will be appreciated that those skilled in the art will be able to devise various arrangements which, although not explicitly described or shown herein, embody the principles of the invention and are included within its spirit and scope. Furthermore, all examples and conditional language recited herein are principally intended to aid the reader in understanding the principles of the invention and the concepts contributed by the inventors to furthering the art, and are to be construed as being without limitation to such specifically recited examples and conditions. Moreover, all statements herein reciting principles, aspects, and embodiments of the invention as well as specific examples thereof, are intended to encompass both structural and functional equivalents thereof. Additionally, it is intended that such equivalents include both currently known equivalents and equivalents developed in the future, i.e., any elements developed that perform the same function, regardless of structure. Moreover, nothing disclosed herein is intended to be dedicated to the public regardless of whether such disclosure is explicitly recited in the claims.

The scope of the present invention, therefore, is not intended to be limited to the exemplary embodiments shown and described herein. Rather, the scope and spirit of present invention is embodied by the appended claims. In the claims, 35 U.S.C. § 112(f) or 35 U.S.C. § 112(6) is expressly defined as being invoked for a limitation in the claim only when the exact phrase "means for" or the exact phrase "step for" is recited at the beginning of such limitation in the claim; if such exact phrase is not used in a limitation in the claim, then 35 U.S.C. § 112 (f) or 35 U.S.C. § 112(6) is not invoked.

SEQUENCE LISTING (10640 sequences)

SEQ ID NO: 1 - DNA, 18 bp, Artificial sequence
  synthetic sequence
agcaccgaccagcagaca

SEQ ID NO: 2 - DNA, 18 bp, Artificial sequence
  synthetic sequence
agacacgaccagccacga

SEQ ID NO: 3 - DNA, 20 bp, Artificial sequence
  synthetic sequence
aatgatacggcgaccaccga

SEQ ID NO: 4 - DNA, 24 bp, Artificial sequence
  synthetic sequence
caagcagaagacggcatacgagat

SEQ ID NO: 5 - DNA, 33 bp, Artificial sequence
  synthetic sequence
acactctttccctacacgacgctcttccgatct

SEQ ID NO: 6 - DNA, 34 bp, Artificial sequence
  synthetic sequence
gtgactggagttcagacgtgtgctcttccgatct

SEQ ID NO: 7 - DNA, 30 bp, Artificial sequence
  synthetic sequence
ccatctcatccctgcgtgtctccgactcag

SEQ ID NO: 8 - DNA, 23 bp, Artificial sequence
  synthetic sequence
cctctctatgggcagtcggtgat

SEQ ID NO: 9 - DNA, 16 bp, Artificial sequence
  synthetic sequence
ccacgaccagccacga

SEQ ID NO: 10 - DNA, 33 bp, Artificial sequence
  synthetic sequence
  misc_feature (1)..(1): The nucleotide at position 1 is attached to (NVT30)-Bead.
  misc_feature (18)..(19): A UMI and BC domain are present between the nucleotides at positions 18 and 19.
agcaccgaccagcacagaaccaccgcacgaccg

SEQ ID NO: 11 - DNA, 87 bp, Artificial sequence
  synthetic sequence
  misc_feature (32)..(32): n is a, c, g, or t
  misc_feature (53)..(53): n is a, c, g, or t
  misc_feature (56)..(56): n is a, c, g, or t
ttttttttttttttttttttttttttttttvnagcaccgaccagcacagavvnvvnvvgcccaggaagccgaaccaccgcacgaccg

SEQ ID NO: 12 - DNA, 31 bp, Artificial sequence
  synthetic sequence
tcgtggctggtcgtggcggtcgtgcggtggt

SEQ ID NO: 13 - DNA, 16 bp, Artificial sequence
  synthetic sequence
ccacgaccagccacga

SEQ ID NO: 14 - DNA, 33 bp, Artificial sequence; identical to SEQ ID NO: 10
  synthetic sequence
  misc_feature (1)..(1): The nucleotide at position 1 is attached to (NVT30)-Bead.
  misc_feature (18)..(19): A UMI8 domain and BC14 domain are present between the nucleotides at positions 18 and 19.

SEQ ID NO: 15 - DNA, 21 bp, Artificial sequence
  synthetic sequence
agcagcaccgaccagcagaca

SEQ ID NO: 16 - DNA, 21 bp, Artificial sequence
  synthetic sequence
agcagcaccgaccagcagaca

SEQ ID NO: 17 - DNA, 21 bp, Artificial sequence
  synthetic sequence
acgagcaccgaccagcacaga

SEQ ID NO: 18 - DNA, 73 bp, Artificial sequence
  synthetic sequence
  misc_feature (21)..(23): GSP>sDNA--GSP is present between the nucleotides at positions 21 and 23.
  misc_feature (52)..(53): A BC14 domain and UMI8 domain are present between the nucleotides at positions 52 and 53.
agcagcaccgaccagcagacaaccaccgcacgaccgccacgaccagccacgatctgtgctggtcggtgctcgt

SEQ ID NO: 19 - DNA, 73 bp, Artificial sequence
  synthetic sequence
  misc_feature (21)..(22): A BC14 domain and UMI8 domain are present between the nucleotides at positions 21 and 22.
  misc_feature (52)..(52): GSP>asDNA-GSP is present between the nucleotides at positions 21 and 22.
acgagcaccgaccagcacagatcgtggctggtcgtggcggtcgtgcggtggttgtctgctggtcggtgctgct

SEQ ID NO: 20 - DNA, 43 bp, Artificial sequence
  synthetic sequence
agcagaagacggcatacgagatagcagcaccgaccagcagaca

SEQ ID NO: 21 - DNA, 44 bp, Artificial sequence
  synthetic sequence
acggcgaccaccgagatctacacacgagcaccgaccagcacaga

SEQ ID NO: 22 - DNA, 73 bp, Artificial sequence; identical to SEQ ID NO: 18
  synthetic sequence
  misc_feature (21)..(22): GSP>sDNA--GSP is present between the nucleotides at positions 21 and 22.
  misc_feature (52)..(53): A BC14 domain and UMI8 domain are present between the nucleotides at positions 52 and 53.

SEQ ID NO: 23 - DNA, 73 bp, Artificial sequence; identical to SEQ ID NO: 19
  synthetic sequence
  misc_feature (21)..(22): A UMI8 domain and BC14 domain are present between the nucleotides at positions 21 and 22.
  misc_feature (52)..(53): GSP>asDNA-GSP is present between the nucleotides at positions 52 and 53.

SEQ ID NO: 24 - DNA, 81 bp, Artificial sequence
  synthetic sequence
  misc_feature (32)..(32): n is a, c, g, or t
  misc_feature (35)..(35): n is a, c, g, or t
  misc_feature (81)..(81): n is a, c, g, or t
cggtcgtgcggtggttcggcttcctgggcbbnbbnbbtgtctgctggtcggtgctttttttttttttttttttttttttvn

SEQ ID NO: 25 - DNA, 16 bp, Artificial sequence
  synthetic sequence
ccacgaccagccacga

SEQ ID NO: 26 - DNA, 33 bp, Artificial sequence
  synthetic sequence
atcgtggctggtcgtggcggtcgtgcggtggta

SEQ ID NO: 27 - DNA, 33 bp, Artificial sequence
  synthetic sequence
  misc_feature (18)..(19): A UMI8 domain and BC14 domain are present between the nucleotides at positions.
agcaccgaccagcagacaaccaccgcacgaccg

SEQ ID NO: 28 - DNA, 16 bp, Artificial sequence
  synthetic sequence
ccacgaccagccacga

SEQ ID NO: 29 - DNA, 21 bp, Artificial sequence
  synthetic sequence
acgagcaccgaccagcacaga

SEQ ID NO: 30 - DNA, 21 bp, Artificial sequence
  synthetic sequence
agcagcaccgaccagcagaca

SEQ ID NO: 31 - DNA, 21 bp, Artificial sequence
  synthetic sequence
acgagcaccgaccagcacaga

SEQ ID NO: 32 - DNA, 73 bp, Artificial sequence; identical to SEQ ID NO: 18
  synthetic sequence
  misc_feature (21)..(22): A UMI8 domain and BC14 domain are present between the nucleotides at positions 21 and 22.
  misc_feature (52)..(53): GSP>sDNA--GSP is present between the nucleotides at positions 52 and 53.

SEQ ID NO: 33 - DNA, 73 bp, Artificial sequence; identical to SEQ ID NO: 19
  synthetic sequence
  misc_feature (21)..(22): GSP>sDNA--GSP is present between the nucleotides at positions 52 and 53.
  misc_feature (52)..(53): A UMI8 domain and BC14 domain are present between the nucleotides at positions 52 and 53.

SEQ ID NO: 34 - DNA, 43 bp, Artificial sequence; identical to SEQ ID NO: 20
  synthetic sequence

SEQ ID NO: 35 - DNA, 44 bp, Artificial sequence; identical to SEQ ID NO: 21
  synthetic sequence

SEQ ID NO: 36 - DNA, 124 bp, Artificial sequence
  synthetic sequence
  misc_feature (46)..(47): A UMI8 domain and BC14 domain are present between the nucleotides present at positions 46 and 47.
  misc_feature (77)..(78): GSP>sDNA---sDNA-GSP are present between the nucleotides present at positions 46 and 47.
agcagaagacggcatacgagatagcagcagcaccgaccagcagacaaccaccgcacgaccgccacgaccagccacgatctgtgctggtcggtgctcgtcgtgtgtagatctcggtggtcgccgt

SEQ ID NO: 37 - DNA, 124 bp, Artificial sequence
  synthetic sequence
  misc_feature (47)..(48): GSP>asDNA-asDNA-GSP ispresent between the nucleotides at positions 47 and 48.
  misc_feature (78)..(79): A UMI8 domain and BC14 domain are present between the nucleotides at positions 78 and 79.
acggcgaccaccgagatctacacacgacgagcaccgaccagcacagatcgtggctggtcgtggcggtcgtgcggtggttgtctgctggtcggtgctgctgctatctcgtatgccgtcttctgct

SEQ ID NO: 38 - DNA, 23 bp, Artificial sequence
  synthetic sequence
acgaccgccacgaccagccacga

SEQ ID NO: 39 - DNA, 28 bp, Artificial sequence
  synthetic sequence
acgagatagcagcaccgaccagcagaca

SEQ ID NO: 40 - DNA, 28 bp, Artificial sequence
  synthetic sequence
actacacacgagcaccgaccagcacaga

SEQ ID NO: 41 - DNA, 24 bp, Artificial sequence
  synthetic sequence
tggtcgtggcggtcgtgcggtggt

SEQ ID NO: 42 - DNA, 13 bp, Artificial sequence
  synthetic sequence
ccacgaccagcca

SEQ ID NO: 43 - DNA, 33 bp, Artificial sequence
  synthetic sequence
  misc_feature (1)..(1): The nucleotide at position 1is attached to and X-Bead moiety.
  misc_feature (21)..(22): A barcode domain is present between the nucleotides at positions 21 and 22.
acgagcaccgaccagcacagaaccgcacgaccg

SEQ ID NO: 44 - DNA, 41 bp, Artificial sequence
  synthetic sequence
acgagcaccgaccagcacagagaacaaacaccgcacgaccg

SEQ ID NO: 45 - DNA, 41 bp, Artificial sequence
  synthetic sequence
acgagcaccgaccagcacagaggcgaaacaccgcacgaccg

SEQ ID NO: 46 - DNA, 41 bp, Artificial sequence
  synthetic sequence
acgagcaccgaccagcacagagcaaaaggaccgcacgaccg

SEQ ID NO: 47 - DNA, 12 bp, Artificial sequence
  synthetic sequence
  misc_feature (1)..(12): n is a, c, g, or t
nnnnnnnnnnnn

SEQ ID NO: 48 - DNA, 44 bp, Artificial sequence
  synthetic sequence
  misc_feature (21)..(21): n is a, c, g, or t
  misc_feature (24)..(24): n is a, c, g, or t
agcaccgaccagcacagavvnvvnvvcatcagaccgcacgaccg

SEQ ID NO: 49 - DNA, 12 bp, Artificial sequence
  synthetic sequence
  misc_feature (1)..(12): n is a, c, g, or t
nnnnnnnnnnnn

SEQ ID NO: 50 - DNA, 45 bp, Artificial sequence
  synthetic sequence
  misc_feature (21)..(21): n is a, c, g, or t
  misc_feature (24)..(24): n is a, c, g, or t
agcaccgaccagcacagavvnvvnvvcagcatgaccgcacgaccg

SEQ ID NO: 51 - DNA, 46 bp, Artificial sequence
  synthetic sequence
  misc_feature (21)..(22): A barcode domain is present between the nucleotides at positions 21 and 22.
acgagcaccgaccagcacagaaccgcacgaccgccacgaccagcca

SEQ ID NO: 52 - DNA, 46 bp, Artificial sequence
  synthetic sequence
  misc_feature (21)..(22): A barcode domain is present between the nucleotides at positions 21 and 22.
agcagcaccgaccagcagacaaccgcacgaccgccacgaccagcca

SEQ ID NO: 53 - DNA, 20 bp, Artificial sequence
  synthetic sequence
agcagcaccgaccagcagac

SEQ ID NO: 54 - DNA, 18 bp, Artificial sequence
  synthetic sequence
agcaccgaccagcagaca

SEQ ID NO: 55 - DNA, 18 bp, Artificial sequence
  synthetic sequence
agcaccgaccagcacaga

SEQ ID NO: 56 - DNA, 20 bp, Artificial sequence
  synthetic sequence
acgagcaccgaccagcacag

SEQ ID NO: 57 - DNA, 20 bp, Artificial sequence
  synthetic sequence
agcagcaccgaccagcagac

SEQ ID NO: 58 - DNA, 18 bp, Artificial sequence
  synthetic sequence
agcaccgaccagcagaca

SEQ ID NO: 59 - DNA, 18 bp, Artificial sequence
  synthetic sequence
agcaccgaccagcacaga

SEQ ID NO: 60 - DNA, 20 bp, Artificial sequence
  synthetic sequence
acgagcaccgaccagcacag

SEQ ID NO: 61 - DNA, 42 bp, Artificial sequence
  synthetic sequence
  misc_feature (21)..(22): cDNA is present between the nucleotides at positions
agcagcaccgaccagcagacatctgtgctggtcggtgctcgt

SEQ ID NO: 62 - DNA, 42 bp, Artificial sequence
  synthetic sequence
  misc_feature (21)..(22): cDNA is present between the nucleotides at positions 21 and 22.
tcgtcgtggctggtcgtctgtagacacgaccagccacgagca

SEQ ID NO: 63 - DNA, 53 bp, Artificial sequence
  synthetic sequence
agcagaagacggcatacgagatatacgacagcagcagcaccgaccagcagaca

SEQ ID NO: 64 - DNA, 53 bp, Artificial sequence
  synthetic sequence
agcagaagacggcatacgagatactgatgagcagcagcaccgaccagcagaca

SEQ ID NO: 65 - DNA, 53 bp, Artificial sequence
  synthetic sequence
agcagaagacggcatacgagatagcatcaagcagcagcaccgaccagcagaca

SEQ ID NO: 66 - DNA, 53 bp, Artificial sequence
  synthetic sequence
agcagaagacggcatacgagataagtcgtagcagcagcaccgaccagcagaca

SEQ ID NO: 67 - DNA, 53 bp, Artificial sequence
  synthetic sequence
agcagaagacggcatacgagatatcgcatagcagcagcaccgaccagcagaca

SEQ ID NO: 68 - DNA, 53 bp, Artificial sequence
  synthetic sequence
agcagaagacggcatacgagatacatagcagcagcagcaccgaccagcagaca

SEQ ID NO: 69 - DNA, 54 bp, Artificial sequence
  synthetic sequence
agacacgaccagccacgagcagcacagcatacacatctagagccaccagcggca

SEQ ID NO: 70 - DNA, 54 bp, Artificial sequence
  synthetic sequence
agacacgaccagccacgagcagcagtagtcacacatctagagccaccagcggca

SEQ ID NO: 71 - DNA, 54 bp, Artificial sequence
  synthetic sequence
agacacgaccagccacgagcagcaactacgacacatctagagccaccagcggca

SEQ ID NO: 72 - DNA, 54 bp, Artificial sequence
  synthetic sequence
agacacgaccagccacgagcagcatgctgaacacatctagagccaccagcggca

SEQ ID NO: 73 - DNA, 54 bp, Artificial sequence
  synthetic sequence
agacacgaccagccacgagcagcatacgctacacatctagagccaccagcggca

SEQ ID NO: 74 - DNA, 54 bp, Artificial sequence
  synthetic sequence
agacacgaccagccacgagcagcacgatacacacatctagagccaccagcggca

SEQ ID NO: 75 - DNA, 46 bp, Artificial sequence
  synthetic sequence
agcagaagacggcatacgagatagcagcagcaccgaccagcagaca

SEQ ID NO: 76 - DNA, 47 bp, Artificial sequence
  synthetic sequence
agacacgaccagccacgagcagcacacatctagagccaccagcggca

SEQ ID NO: 77 - DNA, 42 bp, Artificial sequence; identical to SEQ ID NO: 61
  synthetic sequence
  misc_feature (21)..(22): cDNA is present between the nucleotides at position 21 and 22.

SEQ ID NO: 78 - DNA, 42 bp, Artificial sequence; identical to SEQ ID NO: 62
  synthetic sequence
  misc_feature (21)..(22): cDNA is present between the nucleotides at positions 21 and 22.

SEQ ID NO: 79 - DNA, 25 bp, Artificial sequence
  synthetic sequence
tggctggtcgtggcggtcgtgcggt

SEQ ID NO: 80 - DNA, 24 bp, Artificial sequence
  synthetic sequence
agcagcagcaccgaccagcagaca

SEQ ID NO: 81 - DNA, 25 bp, Artificial sequence
  synthetic sequence
accgaccagcaccgccagcacgcca

SEQ ID NO: 82 - DNA, 24 bp, Artificial sequence
  synthetic sequence
tctgtgctggtcggtgctcgtcgt

SEQ ID NO: 83 - DNA, 24 bp, Artificial sequence
  synthetic sequence
agacacgaccagccacgagcagca

SEQ ID NO: 84 - DNA, 26 bp, Artificial sequence
  synthetic sequence
atggctggtcgtggcggtcgtgcggt

SEQ ID NO: 85 - DNA, 14 bp, Artificial sequence
  synthetic sequence
gcccaggaagccga

SEQ ID NO: 86 - DNA, 14 bp, Artificial sequence
  synthetic sequence
ccacggccaacgcc

SEQ ID NO: 87 - DNA, 14 bp, Artificial sequence
  synthetic sequence
gccaagggaccagc

SEQ ID NO: 88 - DNA, 14 bp, Artificial sequence
  synthetic sequence
gaccgcagccgagg

SEQ ID NO: 89 - DNA, 14 bp, Artificial sequence
  synthetic sequence
accacagaacccaa

SEQ ID NO: 90 - DNA, 14 bp, Artificial sequence
  synthetic sequence
cgacagggggagag

SEQ ID NO: 91 - DNA, 14 bp, Artificial sequence
  synthetic sequence
ggaagagcaccggg

SEQ ID NO: 92 - DNA, 14 bp, Artificial sequence
  synthetic sequence
gcccgaagcacgga

SEQ ID NO: 93 - DNA, 14 bp, Artificial sequence
  synthetic sequence
gacagccgaccaac

SEQ ID NO: 94 - DNA, 14 bp, Artificial sequence
  synthetic sequence
gaggcaaggggccc

SEQ ID NO: 95 - DNA, 14 bp, Artificial sequence
  synthetic sequence
acgagcagcagagg

SEQ ID NO: 96 - DNA, 14 bp, Artificial sequence
  synthetic sequence
ccccagcgcagaca

SEQ ID NO: 97 - DNA, 14 bp, Artificial sequence
  synthetic sequence
agacaaagccgaag

SEQ ID NO: 98 - DNA, 14 bp, Artificial sequence
  synthetic sequence
caccgaggggaacg

SEQ ID NO: 99 - DNA, 14 bp, Artificial sequence
  synthetic sequence
caagcgcgacacga

SEQ ID NO: 100 - DNA, 14 bp, Artificial sequence
  synthetic sequence
cacccgaaagccag

SEQ ID NO: 101 - DNA, 14 bp, Artificial sequence
  synthetic sequence
gcgagcgagacgag

SEQ ID NO: 102 - DNA, 14 bp, Artificial sequence
  synthetic sequence
agaggagcaaggga

SEQ ID NO: 103 - DNA, 14 bp, Artificial sequence
  synthetic sequence
gacggtcccgacac

SEQ ID NO: 104 - DNA, 14 bp, Artificial sequence
  synthetic sequence
atacgaacgacggc

SEQ ID NO: 105 - DNA, 14 bp, Artificial sequence
  synthetic sequence
agctcggccaagaa

SEQ ID NO: 106 - DNA, 14 bp, Artificial sequence
  synthetic sequence
acgagagtagccga

SEQ ID NO: 107 - DNA, 14 bp, Artificial sequence
  synthetic sequence
atgagcggaaagaa

SEQ ID NO: 108 - DNA, 14 bp, Artificial sequence
  synthetic sequence
ggcaaaaacccatc

SEQ ID NO: 109 - DNA, 14 bp, Artificial sequence
  synthetic sequence
aggggagacccgtc

SEQ ID NO: 110 - DNA, 14 bp, Artificial sequence
  synthetic sequence
agcaagggcctgcg

SEQ ID NO: 111 - DNA, 14 bp, Artificial sequence
  synthetic sequence
gccgcaaagtggga

SEQ ID NO: 112 - DNA, 14 bp, Artificial sequence
  synthetic sequence
gcccaaagtcgaac

SEQ ID NO: 113 - DNA, 14 bp, Artificial sequence
  synthetic sequence
caaggtcgccggga

SEQ ID NO: 114 - DNA, 14 bp, Artificial sequence
  synthetic sequence
aatgacggcaagcc

SEQ ID NO: 115 - DNA, 14 bp, Artificial sequence
  synthetic sequence
gagccacgagtcac

SEQ ID NO: 116 - DNA, 14 bp, Artificial sequence
  synthetic sequence
gaggcgcaatacac

SEQ ID NO: 117 - DNA, 14 bp, Artificial sequence
  synthetic sequence
tagggaaccacacc

SEQ ID NO: 118 - DNA, 14 bp, Artificial sequence
  synthetic sequence
ggggaatgaccaga

SEQ ID NO: 119 - DNA, 14 bp, Artificial sequence
  synthetic sequence
atgaagaaacaagg

SEQ ID NO: 120 - DNA, 14 bp, Artificial sequence
  synthetic sequence
aacacgagcggtag

SEQ ID NO: 121 - DNA, 14 bp, Artificial sequence
  synthetic sequence
ggggacgactacga

SEQ ID NO: 122 - DNA, 14 bp, Artificial sequence
  synthetic sequence
ggagacaaggggct

SEQ ID NO: 123 - DNA, 14 bp, Artificial sequence
  synthetic sequence
cctgcaaaggaacg

SEQ ID NO: 124 - DNA, 14 bp, Artificial sequence
  synthetic sequence
gcgaatggaaagca

SEQ ID NO: 125 - DNA, 14 bp, Artificial sequence
  synthetic sequence
cgggctcggacaca

SEQ ID NO: 126 - DNA, 14 bp, Artificial sequence
  synthetic sequence
ggagcgacgtaaac

SEQ ID NO: 127 - DNA, 14 bp, Artificial sequence
  synthetic sequence
cttacaccggaagc

SEQ ID NO: 128 - DNA, 14 bp, Artificial sequence
  synthetic sequence
aatggagaagccta

SEQ ID NO: 129 - DNA, 14 bp, Artificial sequence
  synthetic sequence
gagcgacacgctat

SEQ ID NO: 130 - DNA, 14 bp, Artificial sequence
  synthetic sequence
atggtcaaaaacga

SEQ ID NO: 131 - DNA, 14 bp, Artificial sequence
  synthetic sequence
ccggacgtgtaaac

SEQ ID NO: 132 - DNA, 14 bp, Artificial sequence
  synthetic sequence
atgcgacaaatagc

SEQ ID NO: 133 - DNA, 14 bp, Artificial sequence
  synthetic sequence
cgttcgaggagcac

SEQ ID NO: 134 - DNA, 14 bp, Artificial sequence
  synthetic sequence
cgtcggaacaacat

SEQ ID NO: 135 - DNA, 14 bp, Artificial sequence
  synthetic sequence
tgcatcggccaccg

SEQ ID NO: 136 - DNA, 14 bp, Artificial sequence
  synthetic sequence
ttcgcacaccaagc

SEQ ID NO: 137 - DNA, 14 bp, Artificial sequence
  synthetic sequence
gatgacccgaagat

SEQ ID NO: 138 - DNA, 14 bp, Artificial sequence
  synthetic sequence
gcttgggagagggc

SEQ ID NO: 139 - DNA, 14 bp, Artificial sequence
  synthetic sequence
aacacctggatggg

SEQ ID NO: 140 - DNA, 14 bp, Artificial sequence
  synthetic sequence
ccactcgctccgca

SEQ ID NO: 141 - DNA, 14 bp, Artificial sequence
  synthetic sequence
atcaagcggtgaag

SEQ ID NO: 142 - DNA, 14 bp, Artificial sequence
  synthetic sequence
agcaggcgaagtta

SEQ ID NO: 143 - DNA, 14 bp, Artificial sequence
  synthetic sequence
cgagggtcgagtcg

SEQ ID NO: 144 - DNA, 14 bp, Artificial sequence
  synthetic sequence
acccaaaaacttcg

SEQ ID NO: 145 - DNA, 14 bp, Artificial sequence
  synthetic sequence
aggctggaggatag

SEQ ID NO: 146 - DNA, 14 bp, Artificial sequence
  synthetic sequence
tgatccagaggcca

SEQ ID NO: 147 - DNA, 14 bp, Artificial sequence
  synthetic sequence
aagaccacttccca

SEQ ID NO: 148 - DNA, 14 bp, Artificial sequence
  synthetic sequence
agatgtagcggagg

SEQ ID NO: 149 - DNA, 14 bp, Artificial sequence
  synthetic sequence
gaaacgcacctgct

SEQ ID NO: 150 - DNA, 14 bp, Artificial sequence
  synthetic sequence
agggcagtaggact

SEQ ID NO: 151 - DNA, 14 bp, Artificial sequence
  synthetic sequence
gatcctaaccaacc

SEQ ID NO: 152 - DNA, 14 bp, Artificial sequence
  synthetic sequence
cagcgtcgcgagtg

SEQ ID NO: 153 - DNA, 14 bp, Artificial sequence
  synthetic sequence
gtactaacacagca

SEQ ID NO: 154 - DNA, 14 bp, Artificial sequence
  synthetic sequence
agaggtgaacaaat

SEQ ID NO: 155 - DNA, 14 bp, Artificial sequence
  synthetic sequence
cccctaagggcctg

SEQ ID NO: 156 - DNA, 14 bp, Artificial sequence
  synthetic sequence
tgccgtcgcgaaac

SEQ ID NO: 157 - DNA, 14 bp, Artificial sequence
  synthetic sequence
ccacatcgcaacct

SEQ ID NO: 158 - DNA, 14 bp, Artificial sequence
  synthetic sequence
gcggctgcctcacg

SEQ ID NO: 159 - DNA, 14 bp, Artificial sequence
  synthetic sequence
cactacaaggggat

SEQ ID NO: 160 - DNA, 14 bp, Artificial sequence
  synthetic sequence
tagaccccctgacc

SEQ ID NO: 161 - DNA, 14 bp, Artificial sequence
  synthetic sequence
accgggaacttacc

SEQ ID NO: 162 - DNA, 14 bp, Artificial sequence
  synthetic sequence
tagataaccgggca

SEQ ID NO: 163 - DNA, 14 bp, Artificial sequence
  synthetic sequence
ctgggggaagcaat

SEQ ID NO: 164 - DNA, 14 bp, Artificial sequence
  synthetic sequence
cggctatggcccag

SEQ ID NO: 165 - DNA, 14 bp, Artificial sequence
  synthetic sequence
tctgcgaggggcga

SEQ ID NO: 166 - DNA, 14 bp, Artificial sequence
  synthetic sequence
cccaggggcttcga

SEQ ID NO: 167 - DNA, 14 bp, Artificial sequence
  synthetic sequence
tggggacctgcgac

SEQ ID NO: 168 - DNA, 14 bp, Artificial sequence
  synthetic sequence
gcattagcagagcg

SEQ ID NO: 169 - DNA, 14 bp, Artificial sequence
  synthetic sequence
tgagaccacagtcg

SEQ ID NO: 170 - DNA, 14 bp, Artificial sequence
  synthetic sequence
ctcggcgatctcaa

SEQ ID NO: 171 - DNA, 14 bp, Artificial sequence
  synthetic sequence
cggtattgagagcg

SEQ ID NO: 172 - DNA, 14 bp, Artificial sequence
  synthetic sequence
ccttggtcccgaag

SEQ ID NO: 173 - DNA, 14 bp, Artificial sequence
  synthetic sequence
tgatcgacctcggc

SEQ ID NO: 174 - DNA, 14 bp, Artificial sequence
  synthetic sequence
tgcgggtggtgacc

SEQ ID NO: 175 - DNA, 14 bp, Artificial sequence
  synthetic sequence
tccacctagggctg

SEQ ID NO: 176 - DNA, 14 bp, Artificial sequence
  synthetic sequence
gcacctgctggata

SEQ ID NO: 177 - DNA, 14 bp, Artificial sequence
  synthetic sequence
gccctgccgcttga

SEQ ID NO: 178 - DNA, 14 bp, Artificial sequence
  synthetic sequence
gggcatctagaata

SEQ ID NO: 179 - DNA, 14 bp, Artificial sequence
  synthetic sequence
aggttgtgggcggg

SEQ ID NO: 180 - DNA, 14 bp, Artificial sequence
  synthetic sequence
tactcccgtcaaca

SEQ ID NO: 181 - DNA, 14 bp, Artificial sequence
  synthetic sequence
taaagctgagtcaa

SEQ ID NO: 182 - DNA, 14 bp, Artificial sequence
  synthetic sequence
gtacgcaaattagc

SEQ ID NO: 183 - DNA, 14 bp, Artificial sequence
  synthetic sequence
gtaagtgggctagg

SEQ ID NO: 184 - DNA, 14 bp, Artificial sequence
  synthetic sequence
tatggcgcaacgta

SEQ ID NO: 185 - DNA, 14 bp, Artificial sequence
  synthetic sequence
accagacgtctgta

SEQ ID NO: 186 - DNA, 14 bp, Artificial sequence
  synthetic sequence
ggtaatacgctacg

SEQ ID NO: 187 - DNA, 14 bp, Artificial sequence
  synthetic sequence
actcccctcgtaac

SEQ ID NO: 188 - DNA, 14 bp, Artificial sequence
  synthetic sequence
cacgtggctccgct

SEQ ID NO: 189 - DNA, 14 bp, Artificial sequence
  synthetic sequence
acggcgtactatac

SEQ ID NO: 190 - DNA, 14 bp, Artificial sequence
  synthetic sequence
gccaacgtatatca

SEQ ID NO: 191 - DNA, 14 bp, Artificial sequence
  synthetic sequence
cttaaacccgtcag

SEQ ID NO: 192 - DNA, 14 bp, Artificial sequence
  synthetic sequence
cctgttgcggaagg

SEQ ID NO: 193 - DNA, 14 bp, Artificial sequence
  synthetic sequence
acattgcggtccgc

SEQ ID NO: 194 - DNA, 14 bp, Artificial sequence
  synthetic sequence
gagacactgcttcg

SEQ ID NO: 195 - DNA, 14 bp, Artificial sequence
  synthetic sequence
actatacccggtca

SEQ ID NO: 196 - DNA, 14 bp, Artificial sequence
  synthetic sequence
gtccacctgtgaca

SEQ ID NO: 197 - DNA, 14 bp, Artificial sequence
  synthetic sequence
gcatcaggcggttc

SEQ ID NO: 198 - DNA, 14 bp, Artificial sequence
  synthetic sequence
atcaaggaggcttc

SEQ ID NO: 199 - DNA, 14 bp, Artificial sequence
  synthetic sequence
gtgccttaaaggca

SEQ ID NO: 200 - DNA, 14 bp, Artificial sequence
  synthetic sequence
tggcctccacagtg

SEQ ID NO: 201 - DNA, 14 bp, Artificial sequence
  synthetic sequence
tgaggaggacttcg

SEQ ID NO: 202 - DNA, 14 bp, Artificial sequence
  synthetic sequence
gtcccgagctcgtc

SEQ ID NO: 203 - DNA, 14 bp, Artificial sequence
  synthetic sequence
cagctattccgagg

SEQ ID NO: 204 - DNA, 14 bp, Artificial sequence
  synthetic sequence
taagatcccaagct

SEQ ID NO: 205 - DNA, 14 bp, Artificial sequence
  synthetic sequence
accccatagctgct

SEQ ID NO: 206 - DNA, 14 bp, Artificial sequence
  synthetic sequence
agctgcctgtacca

SEQ ID NO: 207 - DNA, 14 bp, Artificial sequence
  synthetic sequence
tcagacattaaaaa

SEQ ID NO: 208 - DNA, 14 bp, Artificial sequence
  synthetic sequence
agtagaggtggtag

SEQ ID NO: 209 - DNA, 14 bp, Artificial sequence
  synthetic sequence
atgtgctacgcccg

SEQ ID NO: 210 - DNA, 14 bp, Artificial sequence
  synthetic sequence
cgcagaaatattcg

SEQ ID NO: 211 - DNA, 14 bp, Artificial sequence
  synthetic sequence
cggtgcctataggg

SEQ ID NO: 212 - DNA, 14 bp, Artificial sequence
  synthetic sequence
ccccgtctgactca

SEQ ID NO: 213 - DNA, 14 bp, Artificial sequence
  synthetic sequence
gtagcagatgacgt

SEQ ID NO: 214 - DNA, 14 bp, Artificial sequence
  synthetic sequence
aggaaaggcatctt

SEQ ID NO: 215 - DNA, 14 bp, Artificial sequence
  synthetic sequence
gaacagcattgtaa

SEQ ID NO: 216 - DNA, 14 bp, Artificial sequence
  synthetic sequence
cccgatctaaatgc

SEQ ID NO: 217 - DNA, 14 bp, Artificial sequence
  synthetic sequence
cggtgcccaagatt

SEQ ID NO: 218 - DNA, 14 bp, Artificial sequence
  synthetic sequence
gaatccgcagttca

SEQ ID NO: 219 - DNA, 14 bp, Artificial sequence
  synthetic sequence
gtaacagccttgca

SEQ ID NO: 220 - DNA, 14 bp, Artificial sequence
  synthetic sequence
tattaaagcgaagg

SEQ ID NO: 221 - DNA, 14 bp, Artificial sequence
  synthetic sequence
gaactgagtgagta

SEQ ID NO: 222 - DNA, 14 bp, Artificial sequence
  synthetic sequence
tccaagactgacgt

SEQ ID NO: 223 - DNA, 14 bp, Artificial sequence
  synthetic sequence
cataagattcgcac

SEQ ID NO: 224 - DNA, 14 bp, Artificial sequence
  synthetic sequence
agggctgatgtgaa

SEQ ID NO: 225 - DNA, 14 bp, Artificial sequence
  synthetic sequence
agaccatactaatg

SEQ ID NO: 226 - DNA, 14 bp, Artificial sequence
  synthetic sequence
gaaccggacatctt

SEQ ID NO: 227 - DNA, 14 bp, Artificial sequence
  synthetic sequence
aatactgaggtccg

SEQ ID NO: 228 - DNA, 14 bp, Artificial sequence
  synthetic sequence
acgttggtcgaaga

SEQ ID NO: 229 - DNA, 14 bp, Artificial sequence
  synthetic sequence
gctagtggaccgta

SEQ ID NO: 230 - DNA, 14 bp, Artificial sequence
  synthetic sequence
agacgcctatcgtg

SEQ ID NO: 231 - DNA, 14 bp, Artificial sequence
  synthetic sequence
gtcagacaagctct

SEQ ID NO: 232 - DNA, 14 bp, Artificial sequence
  synthetic sequence
gttgcaagtccgca

SEQ ID NO: 233 - DNA, 14 bp, Artificial sequence
  synthetic sequence
gcgaaccatattgc

SEQ ID NO: 234 - DNA, 14 bp, Artificial sequence
  synthetic sequence
ttcatagaggcacg

SEQ ID NO: 235 - DNA, 14 bp, Artificial sequence
  synthetic sequence
ttcaccgggagtaa

SEQ ID NO: 236 - DNA, 14 bp, Artificial sequence
  synthetic sequence
gacttgaatcggaa

SEQ ID NO: 237 - DNA, 14 bp, Artificial sequence
  synthetic sequence
cttgggagtgagac

SEQ ID NO: 238 - DNA, 14 bp, Artificial sequence
  synthetic sequence
gccagataatgcat

SEQ ID NO: 239 - DNA, 14 bp, Artificial sequence
  synthetic sequence
actaaaccgttccc

SEQ ID NO: 240 - DNA, 14 bp, Artificial sequence
  synthetic sequence
tcgcgctggcactg

SEQ ID NO: 241 - DNA, 14 bp, Artificial sequence
  synthetic sequence
tacacgtacgtccg

SEQ ID NO: 242 - DNA, 14 bp, Artificial sequence
  synthetic sequence
agagccggtttcaa

SEQ ID NO: 243 - DNA, 14 bp, Artificial sequence
  synthetic sequence
caaatactgctgga

SEQ ID NO: 244 - DNA, 14 bp, Artificial sequence
  synthetic sequence
ctcgcgacagtcgt

SEQ ID NO: 245 - DNA, 14 bp, Artificial sequence
  synthetic sequence
gaatctaccgctgc

SEQ ID NO: 246 - DNA, 14 bp, Artificial sequence
  synthetic sequence
ccaggggaaattat

SEQ ID NO: 247 - DNA, 14 bp, Artificial sequence
  synthetic sequence
tcgttaagcgcacg

SEQ ID NO: 248 - DNA, 14 bp, Artificial sequence
  synthetic sequence
caagaggctctagt

SEQ ID NO: 249 - DNA, 14 bp, Artificial sequence
  synthetic sequence
ctagtgaactgagg

SEQ ID NO: 250 - DNA, 14 bp, Artificial sequence
  synthetic sequence
cccgaagttcactc

SEQ ID NO: 251 - DNA, 14 bp, Artificial sequence
  synthetic sequence
taacgagtggatag

SEQ ID NO: 252 - DNA, 14 bp, Artificial sequence
  synthetic sequence
cgacgtttgcgaga

SEQ ID NO: 253 - DNA, 14 bp, Artificial sequence
  synthetic sequence
agtactgaatccca

SEQ ID NO: 254 - DNA, 14 bp, Artificial sequence
  synthetic sequence
gaacgtcggctgat

SEQ ID NO: 255 - DNA, 14 bp, Artificial sequence
  synthetic sequence
agggtgcggcactt

SEQ ID NO: 256 - DNA, 14 bp, Artificial sequence
  synthetic sequence
ttagggtcgccgtc

SEQ ID NO: 257 - DNA, 14 bp, Artificial sequence
  synthetic sequence
atacagttccagtg

SEQ ID NO: 258 - DNA, 14 bp, Artificial sequence
  synthetic sequence
atgcctgctcagtc

SEQ ID NO: 259 - DNA, 14 bp, Artificial sequence
  synthetic sequence
ctttagccatcacg

SEQ ID NO: 260 - DNA, 14 bp, Artificial sequence
  synthetic sequence
ctgaaaaatctgat

SEQ ID NO: 261 - DNA, 14 bp, Artificial sequence
  synthetic sequence
atgtaggccctggt

SEQ ID NO: 262 - DNA, 14 bp, Artificial sequence
  synthetic sequence
taccttaagtggaa

SEQ ID NO: 263 - DNA, 14 bp, Artificial sequence
  synthetic sequence
ttcggacaggtcct

SEQ ID NO: 264 - DNA, 14 bp, Artificial sequence
  synthetic sequence
ggtctgtcggctca

SEQ ID NO: 265 - DNA, 14 bp, Artificial sequence
  synthetic sequence
ccctcagcagttct

SEQ ID NO: 266 - DNA, 14 bp, Artificial sequence
  synthetic sequence
ccgtgcaccggttt

SEQ ID NO: 267 - DNA, 14 bp, Artificial sequence
  synthetic sequence
gttattccgcgaag

SEQ ID NO: 268 - DNA, 14 bp, Artificial sequence
  synthetic sequence
atttaacggaatac

SEQ ID NO: 269 - DNA, 14 bp, Artificial sequence
  synthetic sequence
cagagatttctgag

SEQ ID NO: 270 - DNA, 14 bp, Artificial sequence
  synthetic sequence
ctcatgactgaatc

SEQ ID NO: 271 - DNA, 14 bp, Artificial sequence
  synthetic sequence
gtggctgccggttc

SEQ ID NO: 272 - DNA, 14 bp, Artificial sequence
  synthetic sequence
gtgcaggaattgtg

SEQ ID NO: 273 - DNA, 14 bp, Artificial sequence
  synthetic sequence
caaatgtactcgtg

SEQ ID NO: 274 - DNA, 14 bp, Artificial sequence
  synthetic sequence
gttaggtaacgtca

SEQ ID NO: 275 - DNA, 14 bp, Artificial sequence
  synthetic sequence
tctaagtgtagcac

SEQ ID NO: 276 - DNA, 14 bp, Artificial sequence
  synthetic sequence
tcagtgactaccat

SEQ ID NO: 277 - DNA, 14 bp, Artificial sequence
  synthetic sequence
gtcttcaacagctg

SEQ ID NO: 278 - DNA, 14 bp, Artificial sequence
  synthetic sequence
ataaaactctagct

SEQ ID NO: 279 - DNA, 14 bp, Artificial sequence
  synthetic sequence
ctgggtgttggcgc

SEQ ID NO: 280 - DNA, 14 bp, Artificial sequence
  synthetic sequence
ggctcatagtgagt

SEQ ID NO: 281 - DNA, 14 bp, Artificial sequence
  synthetic sequence
gtgcagttgtaggg

SEQ ID NO: 282 - DNA, 14 bp, Artificial sequence
  synthetic sequence
tcgcaagacttatg

SEQ ID NO: 283 - DNA, 14 bp, Artificial sequence
  synthetic sequence
cgcatttagcagta

SEQ ID NO: 284 - DNA, 14 bp, Artificial sequence
  synthetic sequence
cttcagggaatggt

SEQ ID NO: 285 - DNA, 14 bp, Artificial sequence
  synthetic sequence
agcacatttggctc

SEQ ID NO: 286 - DNA, 14 bp, Artificial sequence
  synthetic sequence
acccgagattttac

SEQ ID NO: 287 - DNA, 14 bp, Artificial sequence
  synthetic sequence
ggtagcaatgtatc

SEQ ID NO: 288 - DNA, 14 bp, Artificial sequence
  synthetic sequence
ggaatgtagctatc

SEQ ID NO: 289 - DNA, 14 bp, Artificial sequence
  synthetic sequence
gagattctaacaat

SEQ ID NO: 290 - DNA, 14 bp, Artificial sequence
  synthetic sequence
cgctcatcatatcg

SEQ ID NO: 291 - DNA, 14 bp, Artificial sequence
  synthetic sequence
aaaagtagttcgtc

SEQ ID NO: 292 - DNA, 14 bp, Artificial sequence
  synthetic sequence
atgacaactaatgt

SEQ ID NO: 293 - DNA, 14 bp, Artificial sequence
  synthetic sequence
aattgaatcctaac

SEQ ID NO: 294 - DNA, 14 bp, Artificial sequence
  synthetic sequence
tctggaaagagtct

SEQ ID NO: 295 - DNA, 14 bp, Artificial sequence
  synthetic sequence
atgtaccgatagtc

SEQ ID NO: 296 - DNA, 14 bp, Artificial sequence
  synthetic sequence
actaggcgttccgt

SEQ ID NO: 297 - DNA, 14 bp, Artificial sequence
  synthetic sequence
ggtcgcacttaatg

SEQ ID NO: 298 - DNA, 14 bp, Artificial sequence
  synthetic sequence
tcgtataacggctc

SEQ ID NO: 299 - DNA, 14 bp, Artificial sequence
  synthetic sequence
tccgacaggtgctt

SEQ ID NO: 300 - DNA, 14 bp, Artificial sequence
  synthetic sequence
atggagttcagctc

SEQ ID NO: 301 - DNA, 14 bp, Artificial sequence
  synthetic sequence
cggcttactcagat

SEQ ID NO: 302 - DNA, 14 bp, Artificial sequence
  synthetic sequence
ctgtcactgcatac

SEQ ID NO: 303 - DNA, 14 bp, Artificial sequence
  synthetic sequence
ggcgtttcactaaa

SEQ ID NO: 304 - DNA, 14 bp, Artificial sequence
  synthetic sequence
acattttacgcagc

SEQ ID NO: 305 - DNA, 14 bp, Artificial sequence
  synthetic sequence
cattcataacatga

SEQ ID NO: 306 - DNA, 14 bp, Artificial sequence
  synthetic sequence
aatatatgcgaatg

SEQ ID NO: 307 - DNA, 14 bp, Artificial sequence
  synthetic sequence
cgtttaaccacata

SEQ ID NO: 308 - DNA, 14 bp, Artificial sequence
  synthetic sequence
cgaactagttgaat

SEQ ID NO: 309 - DNA, 14 bp, Artificial sequence
  synthetic sequence
gatttaagacggtc

SEQ ID NO: 310 - DNA, 14 bp, Artificial sequence
  synthetic sequence
attagcgcactctg

SEQ ID NO: 311 - DNA, 14 bp, Artificial sequence
  synthetic sequence
actttgcctaaaga

SEQ ID NO: 312 - DNA, 14 bp, Artificial sequence
  synthetic sequence
ttgctgcctgcccg

SEQ ID NO: 313 - DNA, 14 bp, Artificial sequence
  synthetic sequence
ccacattgtcatgg

SEQ ID NO: 314 - DNA, 14 bp, Artificial sequence
  synthetic sequence
cctatcccgctcct

SEQ ID NO: 315 - DNA, 14 bp, Artificial sequence
  synthetic sequence
cgtatcgattcgca

SEQ ID NO: 316 - DNA, 14 bp, Artificial sequence
  synthetic sequence
cgtaagtgtgagtg

SEQ ID NO: 317 - DNA, 14 bp, Artificial sequence
  synthetic sequence
gtccgatgactcat

SEQ ID NO: 318 - DNA, 14 bp, Artificial sequence
  synthetic sequence
tcgaacccttgtac

SEQ ID NO: 319 - DNA, 14 bp, Artificial sequence
  synthetic sequence
aacctctataccgt

SEQ ID NO: 320 - DNA, 14 bp, Artificial sequence
  synthetic sequence
cgttgcagcacgtt

SEQ ID NO: 321 - DNA, 14 bp, Artificial sequence
  synthetic sequence
tcgttcgtcgggcg

SEQ ID NO: 322 - DNA, 14 bp, Artificial sequence
  synthetic sequence
cggtaaattatgag

SEQ ID NO: 323 - DNA, 14 bp, Artificial sequence
  synthetic sequence
actgacgcgattta

SEQ ID NO: 324 - DNA, 14 bp, Artificial sequence
  synthetic sequence
ctgtagatgcccgt

SEQ ID NO: 325 - DNA, 14 bp, Artificial sequence
  synthetic sequence
cctaagttcgacgt

SEQ ID NO: 326 - DNA, 14 bp, Artificial sequence
  synthetic sequence
atgagtctcgcctg

SEQ ID NO: 327 - DNA, 14 bp, Artificial sequence
  synthetic sequence
aatgtaaatctgca

SEQ ID NO: 328 - DNA, 14 bp, Artificial sequence
  synthetic sequence
cctctacccaattc

SEQ ID NO: 329 - DNA, 14 bp, Artificial sequence
  synthetic sequence
gttggtcgcaagtg

SEQ ID NO: 330 - DNA, 14 bp, Artificial sequence
  synthetic sequence
cgctgcctacttag

SEQ ID NO: 331 - DNA, 14 bp, Artificial sequence
  synthetic sequence
ttaacagagattgg

SEQ ID NO: 332 - DNA, 14 bp, Artificial sequence
  synthetic sequence
tcagttaggtagcg

SEQ ID NO: 333 - DNA, 14 bp, Artificial sequence
  synthetic sequence
cacaatgttctcgg

SEQ ID NO: 334 - DNA, 14 bp, Artificial sequence
  synthetic sequence
atcgctagatacta

SEQ ID NO: 335 - DNA, 14 bp, Artificial sequence
  synthetic sequence
atctcgcttagacc

SEQ ID NO: 336 - DNA, 14 bp, Artificial sequence
  synthetic sequence
cgtctcgtcgggct

SEQ ID NO: 337 - DNA, 14 bp, Artificial sequence
  synthetic sequence
cattcagcgcagtt

SEQ ID NO: 338 - DNA, 14 bp, Artificial sequence
  synthetic sequence
tggcggttgtgcac

SEQ ID NO: 339 - DNA, 14 bp, Artificial sequence
  synthetic sequence
ataggtgtcataaa

SEQ ID NO: 340 - DNA, 14 bp, Artificial sequence
  synthetic sequence
accgtctcaagttg

SEQ ID NO: 341 - DNA, 14 bp, Artificial sequence
  synthetic sequence
aaagtcctttcgag

SEQ ID NO: 342 - DNA, 14 bp, Artificial sequence
  synthetic sequence
cgcctatatggttc

SEQ ID NO: 343 - DNA, 14 bp, Artificial sequence
  synthetic sequence
agtcttcgccattc

SEQ ID NO: 344 - DNA, 14 bp, Artificial sequence
  synthetic sequence
ttagactagaatct

SEQ ID NO: 345 - DNA, 14 bp, Artificial sequence
  synthetic sequence
tggagccttaactt

SEQ ID NO: 346 - DNA, 14 bp, Artificial sequence
  synthetic sequence
tccggctgtcatat

SEQ ID NO: 347 - DNA, 14 bp, Artificial sequence
  synthetic sequence
acgttattgtccga

SEQ ID NO: 348 - DNA, 14 bp, Artificial sequence
  synthetic sequence
tctgtccaacatat

SEQ ID NO: 349 - DNA, 14 bp, Artificial sequence
  synthetic sequence
tgacatcatttagc

SEQ ID NO: 350 - DNA, 14 bp, Artificial sequence
  synthetic sequence
tgatttccgctaaa

SEQ ID NO: 351 - DNA, 14 bp, Artificial sequence
  synthetic sequence
ttattcgtaagcgc

SEQ ID NO: 352 - DNA, 14 bp, Artificial sequence
  synthetic sequence
tttcaaactgacct

SEQ ID NO: 353 - DNA, 14 bp, Artificial sequence
  synthetic sequence
tgtaactaattgcg

SEQ ID NO: 354 - DNA, 14 bp, Artificial sequence
  synthetic sequence
tcacttttggccgc

SEQ ID NO: 355 - DNA, 14 bp, Artificial sequence
  synthetic sequence
tggttctgaccggt

SEQ ID NO: 356 - DNA, 14 bp, Artificial sequence
  synthetic sequence
acgtgatcttggat

SEQ ID NO: 357 - DNA, 14 bp, Artificial sequence
  synthetic sequence
gcttgttcctaacg

SEQ ID NO: 358 - DNA, 14 bp, Artificial sequence
  synthetic sequence
cttactatagggct

SEQ ID NO: 359 - DNA, 14 bp, Artificial sequence
  synthetic sequence
ttaagggatagtta

SEQ ID NO: 360 - DNA, 14 bp, Artificial sequence
  synthetic sequence
ggcttcttcgcaat

SEQ ID NO: 361 - DNA, 14 bp, Artificial sequence
  synthetic sequence
atcatgcttgagta

SEQ ID NO: 362 - DNA, 14 bp, Artificial sequence
  synthetic sequence
atcgtctctatcaa

SEQ ID NO: 363 - DNA, 14 bp, Artificial sequence
  synthetic sequence
tttgacttccaaga

SEQ ID NO: 364 - DNA, 14 bp, Artificial sequence
  synthetic sequence
tgtggcctgttgcc

SEQ ID NO: 365 - DNA, 14 bp, Artificial sequence
  synthetic sequence
ttgcctaggatggt

SEQ ID NO: 366 - DNA, 14 bp, Artificial sequence
  synthetic sequence
tgtcgtgacttaac

SEQ ID NO: 367 - DNA, 14 bp, Artificial sequence
  synthetic sequence
atcttagtaactga

SEQ ID NO: 368 - DNA, 14 bp, Artificial sequence
  synthetic sequence
ccctttctacgtga

SEQ ID NO: 369 - DNA, 14 bp, Artificial sequence
  synthetic sequence
ctatgatacagctt

SEQ ID NO: 370 - DNA, 14 bp, Artificial sequence
  synthetic sequence
ctgtttgggccgct

SEQ ID NO: 371 - DNA, 14 bp, Artificial sequence
  synthetic sequence
cggtcatgtccttc

SEQ ID NO: 372 - DNA, 14 bp, Artificial sequence
  synthetic sequence
cgatactgttacat

SEQ ID NO: 373 - DNA, 14 bp, Artificial sequence
  synthetic sequence
gcttcctcacttcc

SEQ ID NO: 374 - DNA, 14 bp, Artificial sequence
  synthetic sequence
cttggatgcttgac

SEQ ID NO: 375 - DNA, 14 bp, Artificial sequence
  synthetic sequence
ttccttccggctct

SEQ ID NO: 376 - DNA, 14 bp, Artificial sequence
  synthetic sequence
tcgcgtgatgttgt

SEQ ID NO: 377 - DNA, 14 bp, Artificial sequence
  synthetic sequence
aagcgttacatttt

SEQ ID NO: 378 - DNA, 14 bp, Artificial sequence
  synthetic sequence
ttttccgactgtac

SEQ ID NO: 379 - DNA, 14 bp, Artificial sequence
  synthetic sequence
agtttcctgcgtgt

SEQ ID NO: 380 - DNA, 14 bp, Artificial sequence
  synthetic sequence
tacagtactatttg

SEQ ID NO: 381 - DNA, 14 bp, Artificial sequence
  synthetic sequence
gtctgattgggtgt

SEQ ID NO: 382 - DNA, 14 bp, Artificial sequence
  synthetic sequence
cgaacttttctgct

SEQ ID NO: 383 - DNA, 14 bp, Artificial sequence
  synthetic sequence
gaatatgtgtagtt

SEQ ID NO: 384 - DNA, 14 bp, Artificial sequence
  synthetic sequence
ggttgcctttctcg

SEQ ID NO: 385 - DNA, 14 bp, Artificial sequence
  synthetic sequence
gactgattttgatt

SEQ ID NO: 386 - DNA, 14 bp, Artificial sequence
  synthetic sequence
tttggatttggtct

SEQ ID NO: 387 - DNA, 14 bp, Artificial sequence
  synthetic sequence
cttattttgcattg

SEQ ID NO: 388 - DNA, 14 bp, Artificial sequence
  synthetic sequence
ctcttgacattttt

SEQ ID NO: 389 - DNA, 14 bp, Artificial sequence
  synthetic sequence
catttacctatttt

SEQ ID NO: 390 - DNA, 14 bp, Artificial sequence
  synthetic sequence
tttgaatagttgtt

SEQ ID NO: 391 - DNA, 14 bp, Artificial sequence
  synthetic sequence
tggtttatgaattt

SEQ ID NO: 392 - DNA, 14 bp, Artificial sequence
  synthetic sequence
tatttgttctctac

SEQ ID NO: 393 - DNA, 14 bp, Artificial sequence
  synthetic sequence
ttttgatacttctg

SEQ ID NO: 394 - DNA, 14 bp, Artificial sequence
  synthetic sequence
gtacatttttctgt

SEQ ID NO: 395 - DNA, 14 bp, Artificial sequence
  synthetic sequence
ttggtttttgactg

SEQ ID NO: 396 - DNA, 14 bp, Artificial sequence
  synthetic sequence
ctctttcgtttcct

SEQ ID NO: 397 - DNA, 14 bp, Artificial sequence
  synthetic sequence
ttttatgctcttat

SEQ ID NO: 398 - DNA, 14 bp, Artificial sequence
  synthetic sequence
cgtcattctttttt

SEQ ID NO: 399 - DNA, 14 bp, Artificial sequence
  synthetic sequence
gccgcaacacccga

SEQ ID NO: 400 - DNA, 14 bp, Artificial sequence
  synthetic sequence
gcggagccagagac

SEQ ID NO: 401 - DNA, 14 bp, Artificial sequence
  synthetic sequence
gaaccaaaacgcgc

SEQ ID NO: 402 - DNA, 14 bp, Artificial sequence
  synthetic sequence
cgaacaccagcccc

SEQ ID NO: 403 - DNA, 14 bp, Artificial sequence
  synthetic sequence
gggaaccccacgcg

SEQ ID NO: 404 - DNA, 14 bp, Artificial sequence
  synthetic sequence
aacgccagcgaccc

SEQ ID NO: 405 - DNA, 14 bp, Artificial sequence
  synthetic sequence
ccagaaaggagaga

SEQ ID NO: 406 - DNA, 14 bp, Artificial sequence
  synthetic sequence
acccacggcgagga

SEQ ID NO: 407 - DNA, 14 bp, Artificial sequence
  synthetic sequence
acacaacaagagga

SEQ ID NO: 408 - DNA, 14 bp, Artificial sequence
  synthetic sequence
acacccagcgcaga

SEQ ID NO: 409 - DNA, 14 bp, Artificial sequence
  synthetic sequence
ggagaccgccaacg

SEQ ID NO: 410 - DNA, 14 bp, Artificial sequence
  synthetic sequence
gcagggaccccacg

SEQ ID NO: 411 - DNA, 14 bp, Artificial sequence
  synthetic sequence
ggaccgcaaaagcc

SEQ ID NO: 412 - DNA, 14 bp, Artificial sequence
  synthetic sequence
agccaagcggggga

SEQ ID NO: 413 - DNA, 14 bp, Artificial sequence
  synthetic sequence
aacaccacgcgaac

SEQ ID NO: 414 - DNA, 14 bp, Artificial sequence
  synthetic sequence
cgcacaggcggaga

SEQ ID NO: 415 - DNA, 14 bp, Artificial sequence
  synthetic sequence
agaccggacggaga

SEQ ID NO: 416 - DNA, 14 bp, Artificial sequence
  synthetic sequence
cgcagagaagagaa

SEQ ID NO: 417 - DNA, 14 bp, Artificial sequence
  synthetic sequence
gcgggaagacagcg

SEQ ID NO: 418 - DNA, 14 bp, Artificial sequence
  synthetic sequence
gaaagagggggcgg

SEQ ID NO: 419 - DNA, 14 bp, Artificial sequence
  synthetic sequence
caaagaccgcgcca

SEQ ID NO: 420 - DNA, 14 bp, Artificial sequence
  synthetic sequence
aggcaacagagggc

SEQ ID NO: 421 - DNA, 14 bp, Artificial sequence
  synthetic sequence
ggaacaacgcccaa

SEQ ID NO: 422 - DNA, 14 bp, Artificial sequence
  synthetic sequence
cgccagcacccacg

SEQ ID NO: 423 - DNA, 14 bp, Artificial sequence
  synthetic sequence
aaagcggcgccggc

SEQ ID NO: 424 - DNA, 14 bp, Artificial sequence
  synthetic sequence
cggaggggaagccg

SEQ ID NO: 425 - DNA, 14 bp, Artificial sequence
  synthetic sequence
aaaaagaacaaggc

SEQ ID NO: 426 - DNA, 14 bp, Artificial sequence
  synthetic sequence
gggacaagaagcga

SEQ ID NO: 427 - DNA, 14 bp, Artificial sequence
  synthetic sequence
cgaggccaaaacaa

SEQ ID NO: 428 - DNA, 14 bp, Artificial sequence
  synthetic sequence
aacacgctccggga

SEQ ID NO: 429 - DNA, 14 bp, Artificial sequence
  synthetic sequence
tcaggggcaagccc

SEQ ID NO: 430 - DNA, 14 bp, Artificial sequence
  synthetic sequence
gaggaggtgcccga

SEQ ID NO: 431 - DNA, 14 bp, Artificial sequence
  synthetic sequence
acgctccacagcga

SEQ ID NO: 432 - DNA, 14 bp, Artificial sequence
  synthetic sequence
ggccaggcgatcga

SEQ ID NO: 433 - DNA, 14 bp, Artificial sequence
  synthetic sequence
ggctcggaggaacc

SEQ ID NO: 434 - DNA, 14 bp, Artificial sequence
  synthetic sequence
ccagagaccggtac

SEQ ID NO: 435 - DNA, 14 bp, Artificial sequence
  synthetic sequence
ccaacgagggctcg

SEQ ID NO: 436 - DNA, 14 bp, Artificial sequence
  synthetic sequence
caatccgacagaag

SEQ ID NO: 437 - DNA, 14 bp, Artificial sequence
  synthetic sequence
acgctcacgccggc

SEQ ID NO: 438 - DNA, 14 bp, Artificial sequence
  synthetic sequence
cgccgatcggaggc

SEQ ID NO: 439 - DNA, 14 bp, Artificial sequence
  synthetic sequence
aaataacgcaccgg

SEQ ID NO: 440 - DNA, 14 bp, Artificial sequence
  synthetic sequence
aggtaaagcgacaa

SEQ ID NO: 441 - DNA, 14 bp, Artificial sequence
  synthetic sequence
cccgagcctgcagg

SEQ ID NO: 442 - DNA, 14 bp, Artificial sequence
  synthetic sequence
caggccaccctagc

SEQ ID NO: 443 - DNA, 14 bp, Artificial sequence
  synthetic sequence
ggcacccggaacct

SEQ ID NO: 444 - DNA, 14 bp, Artificial sequence
  synthetic sequence
agtgcggagacagc

SEQ ID NO: 445 - DNA, 14 bp, Artificial sequence
  synthetic sequence
ggggcactcccaac

SEQ ID NO: 446 - DNA, 14 bp, Artificial sequence
  synthetic sequence
cagctcggacaaga

SEQ ID NO: 447 - DNA, 14 bp, Artificial sequence
  synthetic sequence
tcacgaaaccgaaa

SEQ ID NO: 448 - DNA, 14 bp, Artificial sequence
  synthetic sequence
aagctggcaaccaa

SEQ ID NO: 449 - DNA, 14 bp, Artificial sequence
  synthetic sequence
agcgggtagcgcac

SEQ ID NO: 450 - DNA, 14 bp, Artificial sequence
  synthetic sequence
accagggtcgggcc

SEQ ID NO: 451 - DNA, 14 bp, Artificial sequence
  synthetic sequence
ctgccgacgggaga

SEQ ID NO: 452 - DNA, 14 bp, Artificial sequence
  synthetic sequence
gcgctagaggggcc

SEQ ID NO: 453 - DNA, 14 bp, Artificial sequence
  synthetic sequence
ggtagggcagcacg

SEQ ID NO: 454 - DNA, 14 bp, Artificial sequence
  synthetic sequence
gcaacggcatcaca

SEQ ID NO: 455 - DNA, 14 bp, Artificial sequence
  synthetic sequence
cgagaaagcaagtg

SEQ ID NO: 456 - DNA, 14 bp, Artificial sequence
  synthetic sequence
agacgcctgcaagg

SEQ ID NO: 457 - DNA, 14 bp, Artificial sequence
  synthetic sequence
cataaaacgagcgc

SEQ ID NO: 458 - DNA, 14 bp, Artificial sequence
  synthetic sequence
atgaacaccgacgc

SEQ ID NO: 459 - DNA, 14 bp, Artificial sequence
  synthetic sequence
cccggtggagaaca

SEQ ID NO: 460 - DNA, 14 bp, Artificial sequence
  synthetic sequence
tggacagcaacaga

SEQ ID NO: 461 - DNA, 14 bp, Artificial sequence
  synthetic sequence
atcaccggagaacg

SEQ ID NO: 462 - DNA, 14 bp, Artificial sequence
  synthetic sequence
cacgcctcggcagc

SEQ ID NO: 463 - DNA, 14 bp, Artificial sequence
  synthetic sequence
gagcgcaggatcgg

SEQ ID NO: 464 - DNA, 14 bp, Artificial sequence
  synthetic sequence
agccaccatagaag

SEQ ID NO: 465 - DNA, 14 bp, Artificial sequence
  synthetic sequence
tcacgccaacacca

SEQ ID NO: 466 - DNA, 14 bp, Artificial sequence
  synthetic sequence
aaagcgtgcacaac

SEQ ID NO: 467 - DNA, 14 bp, Artificial sequence
  synthetic sequence
acgagccgatgggc

SEQ ID NO: 468 - DNA, 14 bp, Artificial sequence
  synthetic sequence
tcccccaaaccagg

SEQ ID NO: 469 - DNA, 14 bp, Artificial sequence
  synthetic sequence
gtacccggaagacc

SEQ ID NO: 470 - DNA, 14 bp, Artificial sequence
  synthetic sequence
gcgtgacaaaccag

SEQ ID NO: 471 - DNA, 14 bp, Artificial sequence
  synthetic sequence
ggaggaatcgaaca

SEQ ID NO: 472 - DNA, 14 bp, Artificial sequence
  synthetic sequence
aaaacagcgcaact

SEQ ID NO: 473 - DNA, 14 bp, Artificial sequence
  synthetic sequence
tccagaccggagaa

SEQ ID NO: 474 - DNA, 14 bp, Artificial sequence
  synthetic sequence
actgcgcacaggag

SEQ ID NO: 475 - DNA, 14 bp, Artificial sequence
  synthetic sequence
caaaaacctaggac

SEQ ID NO: 476 - DNA, 14 bp, Artificial sequence
  synthetic sequence
agcaagaatgaacc

SEQ ID NO: 477 - DNA, 14 bp, Artificial sequence
  synthetic sequence
caaccgcgatcaaa

SEQ ID NO: 478 - DNA, 14 bp, Artificial sequence
  synthetic sequence
gagggacccctccg

SEQ ID NO: 479 - DNA, 14 bp, Artificial sequence
  synthetic sequence
cactgcccaaccag

SEQ ID NO: 480 - DNA, 14 bp, Artificial sequence
  synthetic sequence
cggaacggcgagat

SEQ ID NO: 481 - DNA, 14 bp, Artificial sequence
  synthetic sequence
aaaagacggcccgt

SEQ ID NO: 482 - DNA, 14 bp, Artificial sequence
  synthetic sequence
gacatacaggccgc

SEQ ID NO: 483 - DNA, 14 bp, Artificial sequence
  synthetic sequence
cgacgagataaacc

SEQ ID NO: 484 - DNA, 14 bp, Artificial sequence
  synthetic sequence
atcacacccgcaga

SEQ ID NO: 485 - DNA, 14 bp, Artificial sequence
  synthetic sequence
atggaagacggaga

SEQ ID NO: 486 - DNA, 14 bp, Artificial sequence
  synthetic sequence
ctgcgggagcagac

SEQ ID NO: 487 - DNA, 14 bp, Artificial sequence
  synthetic sequence
aacaaaagatcaca

SEQ ID NO: 488 - DNA, 14 bp, Artificial sequence
  synthetic sequence
caacaacacgtacc

SEQ ID NO: 489 - DNA, 14 bp, Artificial sequence
  synthetic sequence
gggcacaacagcta

SEQ ID NO: 490 - DNA, 14 bp, Artificial sequence
  synthetic sequence
gcctgcaagcgcca

SEQ ID NO: 491 - DNA, 14 bp, Artificial sequence
  synthetic sequence
tgggcgagccacag

SEQ ID NO: 492 - DNA, 14 bp, Artificial sequence
  synthetic sequence
acctgagcccccga

SEQ ID NO: 493 - DNA, 14 bp, Artificial sequence
  synthetic sequence
aacaggcaggacgt

SEQ ID NO: 494 - DNA, 14 bp, Artificial sequence
  synthetic sequence
aggcggaatcccgc

SEQ ID NO: 495 - DNA, 14 bp, Artificial sequence
  synthetic sequence
atccgaggcccccg

SEQ ID NO: 496 - DNA, 14 bp, Artificial sequence
  synthetic sequence
gcgccatggcgagc

SEQ ID NO: 497 - DNA, 14 bp, Artificial sequence
  synthetic sequence
cgcgtggaccacga

SEQ ID NO: 498 - DNA, 14 bp, Artificial sequence
  synthetic sequence
caaactacccacga

SEQ ID NO: 499 - DNA, 14 bp, Artificial sequence
  synthetic sequence
gcagccgacccact

SEQ ID NO: 500 - DNA, 14 bp, Artificial sequence
  synthetic sequence
agtggcccacgggg

SEQ ID NO: 501 - DNA, 14 bp, Artificial sequence
  synthetic sequence
acaaacggagcaat

SEQ ID NO: 502 - DNA, 14 bp, Artificial sequence
  synthetic sequence
gacactgcgagcga

SEQ ID NO: 503 - DNA, 14 bp, Artificial sequence
  synthetic sequence
ccacgagcggctgc

SEQ ID NO: 504 - DNA, 14 bp, Artificial sequence
  synthetic sequence
aggagagcgctcca

SEQ ID NO: 505 - DNA, 14 bp, Artificial sequence
  synthetic sequence
cagcaagagtaaga

SEQ ID NO: 506 - DNA, 14 bp, Artificial sequence
  synthetic sequence
gggaagtgccgggc

SEQ ID NO: 507 - DNA, 14 bp, Artificial sequence
  synthetic sequence
ctcgaaccgacccc

SEQ ID NO: 508 - DNA, 14 bp, Artificial sequence
  synthetic sequence
ccgtgcaagacagg

SEQ ID NO: 509 - DNA, 14 bp, Artificial sequence
  synthetic sequence
gcacggataaacca

SEQ ID NO: 510 - DNA, 14 bp, Artificial sequence
  synthetic sequence
atggcaagaaccac

SEQ ID NO: 511 - DNA, 14 bp, Artificial sequence
  synthetic sequence
gagcgcctacagcg

SEQ ID NO: 512 - DNA, 14 bp, Artificial sequence
  synthetic sequence
gctgcccaaccggg

SEQ ID NO: 513 - DNA, 14 bp, Artificial sequence
  synthetic sequence
gagggagagagtaa

SEQ ID NO: 514 - DNA, 14 bp, Artificial sequence
  synthetic sequence
ggcagaatagggga

SEQ ID NO: 515 - DNA, 14 bp, Artificial sequence
  synthetic sequence
gtccaagaacaggc

SEQ ID NO: 516 - DNA, 14 bp, Artificial sequence
  synthetic sequence
aacaaagcaatgag

SEQ ID NO: 517 - DNA, 14 bp, Artificial sequence
  synthetic sequence
gccgagtcggaaag

SEQ ID NO: 518 - DNA, 14 bp, Artificial sequence
  synthetic sequence
acaagaccacagtc

SEQ ID NO: 519 - DNA, 14 bp, Artificial sequence
  synthetic sequence
tgccggacccgagc

SEQ ID NO: 520 - DNA, 14 bp, Artificial sequence
  synthetic sequence
ctggaagcaaggca

SEQ ID NO: 521 - DNA, 14 bp, Artificial sequence
  synthetic sequence
ccaaaacgacgtgc

SEQ ID NO: 522 - DNA, 14 bp, Artificial sequence
  synthetic sequence
aacgacaatgacga

SEQ ID NO: 523 - DNA, 14 bp, Artificial sequence
  synthetic sequence
aaacaagcgcacta

SEQ ID NO: 524 - DNA, 14 bp, Artificial sequence
  synthetic sequence
gaggggtacccaaa

SEQ ID NO: 525 - DNA, 14 bp, Artificial sequence
  synthetic sequence
ccgacgcacgacta

SEQ ID NO: 526 - DNA, 14 bp, Artificial sequence
  synthetic sequence
gcaaagatgaggag

SEQ ID NO: 527 - DNA, 14 bp, Artificial sequence
  synthetic sequence
aaagactaggaaaa

SEQ ID NO: 528 - DNA, 14 bp, Artificial sequence
  synthetic sequence
tgaccagagggcgc

SEQ ID NO: 529 - DNA, 14 bp, Artificial sequence
  synthetic sequence
tcgcaggggaaaga

SEQ ID NO: 530 - DNA, 14 bp, Artificial sequence
  synthetic sequence
cgatggaggaaaag

SEQ ID NO: 531 - DNA, 14 bp, Artificial sequence
  synthetic sequence
gacctcccagcgac

SEQ ID NO: 532 - DNA, 14 bp, Artificial sequence
  synthetic sequence
agcaataacaggga

SEQ ID NO: 533 - DNA, 14 bp, Artificial sequence
  synthetic sequence
caccggaggtcacc

SEQ ID NO: 534 - DNA, 14 bp, Artificial sequence
  synthetic sequence
gaagactgaacacc

SEQ ID NO: 535 - DNA, 14 bp, Artificial sequence
  synthetic sequence
ggaaatcgcaggac

SEQ ID NO: 536 - DNA, 14 bp, Artificial sequence
  synthetic sequence
aaaaacaaggactg

SEQ ID NO: 537 - DNA, 14 bp, Artificial sequence
  synthetic sequence
ggcggtgcaaccca

SEQ ID NO: 538 - DNA, 14 bp, Artificial sequence
  synthetic sequence
ggtgccacgacacg

SEQ ID NO: 539 - DNA, 14 bp, Artificial sequence
  synthetic sequence
acccagtggacacc

SEQ ID NO: 540 - DNA, 14 bp, Artificial sequence
  synthetic sequence
gcagcataaaacag

SEQ ID NO: 541 - DNA, 14 bp, Artificial sequence
  synthetic sequence
gcagcgagaaacgt

SEQ ID NO: 542 - DNA, 14 bp, Artificial sequence
  synthetic sequence
agcgacatcaaaac

SEQ ID NO: 543 - DNA, 14 bp, Artificial sequence
  synthetic sequence
caagatgcaggaaa

SEQ ID NO: 544 - DNA, 14 bp, Artificial sequence
  synthetic sequence
gcgaccagcaagta

SEQ ID NO: 545 - DNA, 14 bp, Artificial sequence
  synthetic sequence
aaaacctacgaagg

SEQ ID NO: 546 - DNA, 14 bp, Artificial sequence
  synthetic sequence
aaaggatgaaagcc

SEQ ID NO: 547 - DNA, 14 bp, Artificial sequence
  synthetic sequence
tcgagggcacgcgg

SEQ ID NO: 548 - DNA, 14 bp, Artificial sequence
  synthetic sequence
ccacagactcccac

SEQ ID NO: 549 - DNA, 14 bp, Artificial sequence
  synthetic sequence
cacgagcgaaagtg

SEQ ID NO: 550 - DNA, 14 bp, Artificial sequence
  synthetic sequence
accggagggagcta

SEQ ID NO: 551 - DNA, 14 bp, Artificial sequence
  synthetic sequence
ggacgtccggcaag

SEQ ID NO: 552 - DNA, 14 bp, Artificial sequence
  synthetic sequence
agcacacgctggca

SEQ ID NO: 553 - DNA, 14 bp, Artificial sequence
  synthetic sequence
taaacggcgggccg

SEQ ID NO: 554 - DNA, 14 bp, Artificial sequence
  synthetic sequence
gcgatggagcccgg

SEQ ID NO: 555 - DNA, 14 bp, Artificial sequence
  synthetic sequence
cgtcaagaaacgcc

SEQ ID NO: 556 - DNA, 14 bp, Artificial sequence
  synthetic sequence
gcataccagaaacg

SEQ ID NO: 557 - DNA, 14 bp, Artificial sequence
  synthetic sequence
accggtatgcgaga

SEQ ID NO: 558 - DNA, 14 bp, Artificial sequence
  synthetic sequence
agtcacccctaaca

SEQ ID NO: 559 - DNA, 14 bp, Artificial sequence
  synthetic sequence
acgaaaacccatta

SEQ ID NO: 560 - DNA, 14 bp, Artificial sequence
  synthetic sequence
ctacctgaagaaca

SEQ ID NO: 561 - DNA, 14 bp, Artificial sequence
  synthetic sequence
gcaagtcgcgatcc

SEQ ID NO: 562 - DNA, 14 bp, Artificial sequence
  synthetic sequence
tggcaccgaaatag

SEQ ID NO: 563 - DNA, 14 bp, Artificial sequence
  synthetic sequence
ccctcgtggggaca

SEQ ID NO: 564 - DNA, 14 bp, Artificial sequence
  synthetic sequence
ggatctgcaacacg

SEQ ID NO: 565 - DNA, 14 bp, Artificial sequence
  synthetic sequence
gtggaccataacag

SEQ ID NO: 566 - DNA, 14 bp, Artificial sequence
  synthetic sequence
cggctgccaaggct

SEQ ID NO: 567 - DNA, 14 bp, Artificial sequence
  synthetic sequence
cgactcatacaaca

SEQ ID NO: 568 - DNA, 14 bp, Artificial sequence
  synthetic sequence
gtaagctagggaag

SEQ ID NO: 569 - DNA, 14 bp, Artificial sequence
  synthetic sequence
acgaacggagttcg

SEQ ID NO: 570 - DNA, 14 bp, Artificial sequence
  synthetic sequence
acactgggacgagt

SEQ ID NO: 571 - DNA, 14 bp, Artificial sequence
  synthetic sequence
agcatgatgccgcc

SEQ ID NO: 572 - DNA, 14 bp, Artificial sequence
  synthetic sequence
gatccagccgggtg

SEQ ID NO: 573 - DNA, 14 bp, Artificial sequence
  synthetic sequence
gtcgactcaaggga

SEQ ID NO: 574 - DNA, 14 bp, Artificial sequence
  synthetic sequence
aaagagacccgatt

SEQ ID NO: 575 - DNA, 14 bp, Artificial sequence
  synthetic sequence
ggcagctctgaagc

SEQ ID NO: 576 - DNA, 14 bp, Artificial sequence
  synthetic sequence
ccggtctcagcaca

SEQ ID NO: 577 - DNA, 14 bp, Artificial sequence
  synthetic sequence
gacaggatcagtcc

SEQ ID NO: 578 - DNA, 14 bp, Artificial sequence
  synthetic sequence
ccgatcgaaatacg

SEQ ID NO: 579 - DNA, 14 bp, Artificial sequence
  synthetic sequence
gccggtcgatccaa

SEQ ID NO: 580 - DNA, 14 bp, Artificial sequence
  synthetic sequence
gaccagctcctgac

SEQ ID NO: 581 - DNA, 14 bp, Artificial sequence
  synthetic sequence
attaagagaacgag

SEQ ID NO: 582 - DNA, 14 bp, Artificial sequence
  synthetic sequence
cgtacaaggatggc

SEQ ID NO: 583 - DNA, 14 bp, Artificial sequence
  synthetic sequence
tagtcgccagccaa

SEQ ID NO: 584 - DNA, 14 bp, Artificial sequence
  synthetic sequence
gcccaagtgataca

SEQ ID NO: 585 - DNA, 14 bp, Artificial sequence
  synthetic sequence
gaacgcggtgtaag

SEQ ID NO: 586 - DNA, 14 bp, Artificial sequence
  synthetic sequence
ggctaataaaaaac

SEQ ID NO: 587 - DNA, 14 bp, Artificial sequence
  synthetic sequence
cagacggcacctta

SEQ ID NO: 588 - DNA, 14 bp, Artificial sequence
  synthetic sequence
aacggcgttgacac

SEQ ID NO: 589 - DNA, 14 bp, Artificial sequence
  synthetic sequence
ccatatggaggcgc

SEQ ID NO: 590 - DNA, 14 bp, Artificial sequence
  synthetic sequence
gtaagtacaaggag

SEQ ID NO: 591 - DNA, 14 bp, Artificial sequence
  synthetic sequence
gatgcgacccgtcc

SEQ ID NO: 592 - DNA, 14 bp, Artificial sequence
  synthetic sequence
gctgggtaggccgg

SEQ ID NO: 593 - DNA, 14 bp, Artificial sequence
  synthetic sequence
atcccctccgggga

SEQ ID NO: 594 - DNA, 14 bp, Artificial sequence
  synthetic sequence
tagccctcacgccg

SEQ ID NO: 595 - DNA, 14 bp, Artificial sequence
  synthetic sequence
tgcgcgagagaatg

SEQ ID NO: 596 - DNA, 14 bp, Artificial sequence
  synthetic sequence
cgatcgaaaactca

SEQ ID NO: 597 - DNA, 14 bp, Artificial sequence
  synthetic sequence
gacacaccagcgtt

SEQ ID NO: 598 - DNA, 14 bp, Artificial sequence
  synthetic sequence
gaaccaccaagttg

SEQ ID NO: 599 - DNA, 14 bp, Artificial sequence
  synthetic sequence
cgcagcgcgtcatc

SEQ ID NO: 600 - DNA, 14 bp, Artificial sequence
  synthetic sequence
agaaagcacgtcta

SEQ ID NO: 601 - DNA, 14 bp, Artificial sequence
  synthetic sequence
taggacacgggcta

SEQ ID NO: 602 - DNA, 14 bp, Artificial sequence
  synthetic sequence
ctgagacctggaga

SEQ ID NO: 603 - DNA, 14 bp, Artificial sequence
  synthetic sequence
aaagataagatgcc

SEQ ID NO: 604 - DNA, 14 bp, Artificial sequence
  synthetic sequence
aaacaatcataggg

SEQ ID NO: 605 - DNA, 14 bp, Artificial sequence
  synthetic sequence
gagagggtgtcacc

SEQ ID NO: 606 - DNA, 14 bp, Artificial sequence
  synthetic sequence
ctcagtggacgcgc

SEQ ID NO: 607 - DNA, 14 bp, Artificial sequence
  synthetic sequence
ccttaggcgaacca

SEQ ID NO: 608 - DNA, 14 bp, Artificial sequence
  synthetic sequence
gcccctagacaatg

SEQ ID NO: 609 - DNA, 14 bp, Artificial sequence
  synthetic sequence
aagggaaaactatc

SEQ ID NO: 610 - DNA, 14 bp, Artificial sequence
  synthetic sequence
ggtataccgacccc

SEQ ID NO: 611 - DNA, 14 bp, Artificial sequence
  synthetic sequence
taccctagcagaaa

SEQ ID NO: 612 - DNA, 14 bp, Artificial sequence
  synthetic sequence
gctgaccacggcta

SEQ ID NO: 613 - DNA, 14 bp, Artificial sequence
  synthetic sequence
tgcggcaaacgggt

SEQ ID NO: 614 - DNA, 14 bp, Artificial sequence
  synthetic sequence
gcgtggcacgtccc

SEQ ID NO: 615 - DNA, 14 bp, Artificial sequence
  synthetic sequence
cgaacgctgcgcta

SEQ ID NO: 616 - DNA, 14 bp, Artificial sequence
  synthetic sequence
ggtagcggcacact

SEQ ID NO: 617 - DNA, 14 bp, Artificial sequence
  synthetic sequence
ttagccgcaaagcc

SEQ ID NO: 618 - DNA, 14 bp, Artificial sequence
  synthetic sequence
cggccatatgagac

SEQ ID NO: 619 - DNA, 14 bp, Artificial sequence
  synthetic sequence
ggtcggcctaccca

SEQ ID NO: 620 - DNA, 14 bp, Artificial sequence
  synthetic sequence
catccatcccccag

SEQ ID NO: 621 - DNA, 14 bp, Artificial sequence
  synthetic sequence
gccggatcgaccat

SEQ ID NO: 622 - DNA, 14 bp, Artificial sequence
  synthetic sequence
accccaggctgact

SEQ ID NO: 623 - DNA, 14 bp, Artificial sequence
  synthetic sequence
agaggggaatctcc

SEQ ID NO: 624 - DNA, 14 bp, Artificial sequence
  synthetic sequence
caatgtgaggaaag

SEQ ID NO: 625 - DNA, 14 bp, Artificial sequence
  synthetic sequence
ctgcagtcgcaccg

SEQ ID NO: 626 - DNA, 14 bp, Artificial sequence
  synthetic sequence
agtaataaaagcag

SEQ ID NO: 627 - DNA, 14 bp, Artificial sequence
  synthetic sequence
accacgccgtctga

SEQ ID NO: 628 - DNA, 14 bp, Artificial sequence
  synthetic sequence
aagctcaaggtagc

SEQ ID NO: 629 - DNA, 14 bp, Artificial sequence
  synthetic sequence
ggtcgaaatgacga

SEQ ID NO: 630 - DNA, 14 bp, Artificial sequence
  synthetic sequence
ataggcagacatgg

SEQ ID NO: 631 - DNA, 14 bp, Artificial sequence
  synthetic sequence
tggcatacccccca

SEQ ID NO: 632 - DNA, 14 bp, Artificial sequence
  synthetic sequence
agccactacgctgc

SEQ ID NO: 633 - DNA, 14 bp, Artificial sequence
  synthetic sequence
agccccaagtggta

SEQ ID NO: 634 - DNA, 14 bp, Artificial sequence
  synthetic sequence
taggacgtgcgacg

SEQ ID NO: 635 - DNA, 14 bp, Artificial sequence
  synthetic sequence
ctaagaatccgcgc

SEQ ID NO: 636 - DNA, 14 bp, Artificial sequence
  synthetic sequence
cttcgaaccaccga

SEQ ID NO: 637 - DNA, 14 bp, Artificial sequence
  synthetic sequence
gtcactaccccgag

SEQ ID NO: 638 - DNA, 14 bp, Artificial sequence
  synthetic sequence
gcaggaagctgggt

SEQ ID NO: 639 - DNA, 14 bp, Artificial sequence
  synthetic sequence
aatacggccataga

SEQ ID NO: 640 - DNA, 14 bp, Artificial sequence
  synthetic sequence
tcaggcctcgcgcc

SEQ ID NO: 641 - DNA, 14 bp, Artificial sequence
  synthetic sequence
ggcctcaagcgtgg

SEQ ID NO: 642 - DNA, 14 bp, Artificial sequence
  synthetic sequence
tcccgcatcgaaag

SEQ ID NO: 643 - DNA, 14 bp, Artificial sequence
  synthetic sequence
gagtgtgacccacc

SEQ ID NO: 644 - DNA, 14 bp, Artificial sequence
  synthetic sequence
gcctgcataacgac

SEQ ID NO: 645 - DNA, 14 bp, Artificial sequence
  synthetic sequence
aaggaccctgatac

SEQ ID NO: 646 - DNA, 14 bp, Artificial sequence
  synthetic sequence
gatagtcgaaaaga

SEQ ID NO: 647 - DNA, 14 bp, Artificial sequence
  synthetic sequence
gcgggtcaactcgc

SEQ ID NO: 648 - DNA, 14 bp, Artificial sequence
  synthetic sequence
cgttgagcacacag

SEQ ID NO: 649 - DNA, 14 bp, Artificial sequence
  synthetic sequence
agtcgcgaggacgt

SEQ ID NO: 650 - DNA, 14 bp, Artificial sequence
  synthetic sequence
caggacaaggttgg

SEQ ID NO: 651 - DNA, 14 bp, Artificial sequence
  synthetic sequence
acgacggctgatca

SEQ ID NO: 652 - DNA, 14 bp, Artificial sequence
  synthetic sequence
aaatcatgacaaca

SEQ ID NO: 653 - DNA, 14 bp, Artificial sequence
  synthetic sequence
cggcgtacaagcgt

SEQ ID NO: 654 - DNA, 14 bp, Artificial sequence
  synthetic sequence
gttcgggagacaaa

SEQ ID NO: 655 - DNA, 14 bp, Artificial sequence
  synthetic sequence
ctcgtcagaaggca

SEQ ID NO: 656 - DNA, 14 bp, Artificial sequence
  synthetic sequence
acgatgagcgtgca

SEQ ID NO: 657 - DNA, 14 bp, Artificial sequence
  synthetic sequence
gggaccacgtgtgc

SEQ ID NO: 658 - DNA, 14 bp, Artificial sequence
  synthetic sequence
tacagtgacagacg

SEQ ID NO: 659 - DNA, 14 bp, Artificial sequence
  synthetic sequence
taaaggacgcgagt

SEQ ID NO: 660 - DNA, 14 bp, Artificial sequence
  synthetic sequence
gttgaaggaacaac

SEQ ID NO: 661 - DNA, 14 bp, Artificial sequence
  synthetic sequence
cgaactggatcgaa

SEQ ID NO: 662 - DNA, 14 bp, Artificial sequence
  synthetic sequence
aagttccacccaga

SEQ ID NO: 663 - DNA, 14 bp, Artificial sequence
  synthetic sequence
cctagggaaacact

SEQ ID NO: 664 - DNA, 14 bp, Artificial sequence
  synthetic sequence
aacaatcatgggca

SEQ ID NO: 665 - DNA, 14 bp, Artificial sequence
  synthetic sequence
cggctgtaggcaga

SEQ ID NO: 666 - DNA, 14 bp, Artificial sequence
  synthetic sequence
gcacgtcaccggta

SEQ ID NO: 667 - DNA, 14 bp, Artificial sequence
  synthetic sequence
tagcggagggatgc

SEQ ID NO: 668 - DNA, 14 bp, Artificial sequence
  synthetic sequence
gaacccacctcctg

SEQ ID NO: 669 - DNA, 14 bp, Artificial sequence
  synthetic sequence
ccaagatgaaacta

SEQ ID NO: 670 - DNA, 14 bp, Artificial sequence
  synthetic sequence
tccgtgcgccaaca

SEQ ID NO: 671 - DNA, 14 bp, Artificial sequence
  synthetic sequence
gacagcgaggttag

SEQ ID NO: 672 - DNA, 14 bp, Artificial sequence
  synthetic sequence
gagatgaggaatcc

SEQ ID NO: 673 - DNA, 14 bp, Artificial sequence
  synthetic sequence
gccaccgcgtacat

SEQ ID NO: 674 - DNA, 14 bp, Artificial sequence
  synthetic sequence
ctgacacgccgtcg

SEQ ID NO: 675 - DNA, 14 bp, Artificial sequence
  synthetic sequence
ccactagaactacc

SEQ ID NO: 676 - DNA, 14 bp, Artificial sequence
  synthetic sequence
cccataaataagac

SEQ ID NO: 677 - DNA, 14 bp, Artificial sequence
  synthetic sequence
aatcccgagcgagt

SEQ ID NO: 678 - DNA, 14 bp, Artificial sequence
  synthetic sequence
ttcggacccaagag

SEQ ID NO: 679 - DNA, 14 bp, Artificial sequence
  synthetic sequence
ctaggggcacacta

SEQ ID NO: 680 - DNA, 14 bp, Artificial sequence
  synthetic sequence
acgtccgtgcaacc

SEQ ID NO: 681 - DNA, 14 bp, Artificial sequence
  synthetic sequence
atggcgcaggggat

SEQ ID NO: 682 - DNA, 14 bp, Artificial sequence
  synthetic sequence
gagccgtatcgaga

SEQ ID NO: 683 - DNA, 14 bp, Artificial sequence
  synthetic sequence
aacctgggaatcgg

SEQ ID NO: 684 - DNA, 14 bp, Artificial sequence
  synthetic sequence
acccgacttgacgg

SEQ ID NO: 685 - DNA, 14 bp, Artificial sequence
  synthetic sequence
acgattaggcggcc

SEQ ID NO: 686 - DNA, 14 bp, Artificial sequence
  synthetic sequence
ctcggcacacaatc

SEQ ID NO: 687 - DNA, 14 bp, Artificial sequence
  synthetic sequence
agaaccgtcctcgc

SEQ ID NO: 688 - DNA, 14 bp, Artificial sequence
  synthetic sequence
acaacgtgcatcga

SEQ ID NO: 689 - DNA, 14 bp, Artificial sequence
  synthetic sequence
tacagcgcaggctc

SEQ ID NO: 690 - DNA, 14 bp, Artificial sequence
  synthetic sequence
cgggtaaggaatac

SEQ ID NO: 691 - DNA, 14 bp, Artificial sequence
  synthetic sequence
attacggaaagggc

SEQ ID NO: 692 - DNA, 14 bp, Artificial sequence
  synthetic sequence
cagatgatggcaca

SEQ ID NO: 693 - DNA, 14 bp, Artificial sequence
  synthetic sequence
gcaaaggcggttgc

SEQ ID NO: 694 - DNA, 14 bp, Artificial sequence
  synthetic sequence
tacaggaaagtggg

SEQ ID NO: 695 - DNA, 14 bp, Artificial sequence
  synthetic sequence
ctctggaagcgagg

SEQ ID NO: 696 - DNA, 14 bp, Artificial sequence
  synthetic sequence
cgagtaggagccct

SEQ ID NO: 697 - DNA, 14 bp, Artificial sequence
  synthetic sequence
tccaccaggctcca

SEQ ID NO: 698 - DNA, 14 bp, Artificial sequence
  synthetic sequence
tctacaaaacaaaa

SEQ ID NO: 699 - DNA, 14 bp, Artificial sequence
  synthetic sequence
caccaacagatcta

SEQ ID NO: 700 - DNA, 14 bp, Artificial sequence
  synthetic sequence
gcagtgatgccgca

SEQ ID NO: 701 - DNA, 14 bp, Artificial sequence
  synthetic sequence
gggcgttgcacaca

SEQ ID NO: 702 - DNA, 14 bp, Artificial sequence
  synthetic sequence
cggtccaaggctgc

SEQ ID NO: 703 - DNA, 14 bp, Artificial sequence
  synthetic sequence
gccggtgaaagtag

SEQ ID NO: 704 - DNA, 14 bp, Artificial sequence
  synthetic sequence
ataacgaagccggt

SEQ ID NO: 705 - DNA, 14 bp, Artificial sequence
  synthetic sequence
caatcgagtcgggg

SEQ ID NO: 706 - DNA, 14 bp, Artificial sequence
  synthetic sequence
ctccaggccagctg

SEQ ID NO: 707 - DNA, 14 bp, Artificial sequence
  synthetic sequence
attgggaccaggga

SEQ ID NO: 708 - DNA, 14 bp, Artificial sequence
  synthetic sequence
cagactgcggatag

SEQ ID NO: 709 - DNA, 14 bp, Artificial sequence
  synthetic sequence
cgtaacaggaggct

SEQ ID NO: 710 - DNA, 14 bp, Artificial sequence
  synthetic sequence
agccagttgccgag

SEQ ID NO: 711 - DNA, 14 bp, Artificial sequence
  synthetic sequence
ggacgacgattgac

SEQ ID NO: 712 - DNA, 14 bp, Artificial sequence
  synthetic sequence
aatgcatacacaga

SEQ ID NO: 713 - DNA, 14 bp, Artificial sequence
  synthetic sequence
tcgaacatagggcc

SEQ ID NO: 714 - DNA, 14 bp, Artificial sequence
  synthetic sequence
cgacgatcggccat

SEQ ID NO: 715 - DNA, 14 bp, Artificial sequence
  synthetic sequence
caaaaagctacatg

SEQ ID NO: 716 - DNA, 14 bp, Artificial sequence
  synthetic sequence
aatggtcagccggg

SEQ ID NO: 717 - DNA, 14 bp, Artificial sequence
  synthetic sequence
ggggtaaccatcaa

SEQ ID NO: 718 - DNA, 14 bp, Artificial sequence
  synthetic sequence
gatcgggatccccg

SEQ ID NO: 719 - DNA, 14 bp, Artificial sequence
  synthetic sequence
aagggagtccatga

SEQ ID NO: 720 - DNA, 14 bp, Artificial sequence
  synthetic sequence
tcggtgcggaccca

SEQ ID NO: 721 - DNA, 14 bp, Artificial sequence
  synthetic sequence
caggagagccttcc

SEQ ID NO: 722 - DNA, 14 bp, Artificial sequence
  synthetic sequence
aaagaacggcttgc

SEQ ID NO: 723 - DNA, 14 bp, Artificial sequence
  synthetic sequence
cataacatcgcgga

SEQ ID NO: 724 - DNA, 14 bp, Artificial sequence
  synthetic sequence
aaccaggcatgcct

SEQ ID NO: 725 - DNA, 14 bp, Artificial sequence
  synthetic sequence
cgcaagctgctagc

SEQ ID NO: 726 - DNA, 14 bp, Artificial sequence
  synthetic sequence
gctagatgcaggcg

SEQ ID NO: 727 - DNA, 14 bp, Artificial sequence
  synthetic sequence
ggactgggtagccg

SEQ ID NO: 728 - DNA, 14 bp, Artificial sequence
  synthetic sequence
cggtagcacagtac

SEQ ID NO: 729 - DNA, 14 bp, Artificial sequence
  synthetic sequence
tagcactgaggaag

SEQ ID NO: 730 - DNA, 14 bp, Artificial sequence
  synthetic sequence
tgggcatccacgca

SEQ ID NO: 731 - DNA, 14 bp, Artificial sequence
  synthetic sequence
cctaaaaatcaagc

SEQ ID NO: 732 - DNA, 14 bp, Artificial sequence
  synthetic sequence
gtcgtacccccaca

SEQ ID NO: 733 - DNA, 14 bp, Artificial sequence
  synthetic sequence
gtgcgagcacggat

SEQ ID NO: 734 - DNA, 14 bp, Artificial sequence
  synthetic sequence
caagatggccactg

SEQ ID NO: 735 - DNA, 14 bp, Artificial sequence
  synthetic sequence
cgtcgagcctccac

SEQ ID NO: 736 - DNA, 14 bp, Artificial sequence
  synthetic sequence
gagggttcgagaag

SEQ ID NO: 737 - DNA, 14 bp, Artificial sequence
  synthetic sequence
cgacgtgagaccta

SEQ ID NO: 738 - DNA, 14 bp, Artificial sequence
  synthetic sequence
gaggccgatgatcc

SEQ ID NO: 739 - DNA, 14 bp, Artificial sequence
  synthetic sequence
cacctccgtcccca

SEQ ID NO: 740 - DNA, 14 bp, Artificial sequence
  synthetic sequence
gaatggagctcggg

SEQ ID NO: 741 - DNA, 14 bp, Artificial sequence
  synthetic sequence
actgagtggccccg

SEQ ID NO: 742 - DNA, 14 bp, Artificial sequence
  synthetic sequence
agactagccacatc

SEQ ID NO: 743 - DNA, 14 bp, Artificial sequence
  synthetic sequence
cacgatgatccaca

SEQ ID NO: 744 - DNA, 14 bp, Artificial sequence
  synthetic sequence
acaaccgtacaata

SEQ ID NO: 745 - DNA, 14 bp, Artificial sequence
  synthetic sequence
gagagcggtcgctc

SEQ ID NO: 746 - DNA, 14 bp, Artificial sequence
  synthetic sequence
ccaggccaagcttc

SEQ ID NO: 747 - DNA, 14 bp, Artificial sequence
  synthetic sequence
gtgacgtgcccgcg

SEQ ID NO: 748 - DNA, 14 bp, Artificial sequence
  synthetic sequence
tggaacagccgtgg

SEQ ID NO: 749 - DNA, 14 bp, Artificial sequence
  synthetic sequence
cccaacttaacgga

SEQ ID NO: 750 - DNA, 14 bp, Artificial sequence
  synthetic sequence
catcgaaaggcctc

SEQ ID NO: 751 - DNA, 14 bp, Artificial sequence
  synthetic sequence
gaagctaaaacagt

SEQ ID NO: 752 - DNA, 14 bp, Artificial sequence
  synthetic sequence
atgctcccacccga

SEQ ID NO: 753 - DNA, 14 bp, Artificial sequence
  synthetic sequence
agcacagtgtggac

SEQ ID NO: 754 - DNA, 14 bp, Artificial sequence
  synthetic sequence
ggctgagacggtga

SEQ ID NO: 755 - DNA, 14 bp, Artificial sequence
  synthetic sequence
taatgcgcggccgc

SEQ ID NO: 756 - DNA, 14 bp, Artificial sequence
  synthetic sequence
tgccacgcacatcg

SEQ ID NO: 757 - DNA, 14 bp, Artificial sequence
  synthetic sequence
gcctgtaccaggaa

SEQ ID NO: 758 - DNA, 14 bp, Artificial sequence
  synthetic sequence
gcgggtacacgtcc

SEQ ID NO: 759 - DNA, 14 bp, Artificial sequence
  synthetic sequence
gggaccgagcagtt

SEQ ID NO: 760 - DNA, 14 bp, Artificial sequence
  synthetic sequence
tggggcaaggtgac

SEQ ID NO: 761 - DNA, 14 bp, Artificial sequence
  synthetic sequence
caaggcatctcgca

SEQ ID NO: 762 - DNA, 14 bp, Artificial sequence
  synthetic sequence
aaagtgagccgtca

SEQ ID NO: 763 - DNA, 14 bp, Artificial sequence
  synthetic sequence
gaattcggcaccaa

SEQ ID NO: 764 - DNA, 14 bp, Artificial sequence
  synthetic sequence
cgaagtaaggtaaa

SEQ ID NO: 765 - DNA, 14 bp, Artificial sequence
  synthetic sequence
aagaccgtgacgat

SEQ ID NO: 766 - DNA, 14 bp, Artificial sequence
  synthetic sequence
tacacgacctcaca

SEQ ID NO: 767 - DNA, 14 bp, Artificial sequence
  synthetic sequence
ttgcaagggggcga

SEQ ID NO: 768 - DNA, 14 bp, Artificial sequence
  synthetic sequence
gactaaacagccct

SEQ ID NO: 769 - DNA, 14 bp, Artificial sequence
  synthetic sequence
caacaacactagtg

SEQ ID NO: 770 - DNA, 14 bp, Artificial sequence
  synthetic sequence
aagggaaatactga

SEQ ID NO: 771 - DNA, 14 bp, Artificial sequence
  synthetic sequence
agactggtaaagcg

SEQ ID NO: 772 - DNA, 14 bp, Artificial sequence
  synthetic sequence
aatcgaaagtaccg

SEQ ID NO: 773 - DNA, 14 bp, Artificial sequence
  synthetic sequence
gccgtaccaaataa

SEQ ID NO: 774 - DNA, 14 bp, Artificial sequence
  synthetic sequence
ataaagctgagcga

SEQ ID NO: 775 - DNA, 14 bp, Artificial sequence
  synthetic sequence
aactccggaggtac

SEQ ID NO: 776 - DNA, 14 bp, Artificial sequence
  synthetic sequence
tccctagccgaaaa

SEQ ID NO: 777 - DNA, 14 bp, Artificial sequence
  synthetic sequence
cggctgcacagctg

SEQ ID NO: 778 - DNA, 14 bp, Artificial sequence
  synthetic sequence
ctgccaaactacca

SEQ ID NO: 779 - DNA, 14 bp, Artificial sequence
  synthetic sequence
aaattgcgcgaacg

SEQ ID NO: 780 - DNA, 14 bp, Artificial sequence
  synthetic sequence
aggtagcgagtcgg

SEQ ID NO: 781 - DNA, 14 bp, Artificial sequence
  synthetic sequence
cgaaacgcgcttac

SEQ ID NO: 782 - DNA, 14 bp, Artificial sequence
  synthetic sequence
gcatacaactccca

SEQ ID NO: 783 - DNA, 14 bp, Artificial sequence
  synthetic sequence
cggacgatcgtcac

SEQ ID NO: 784 - DNA, 14 bp, Artificial sequence
  synthetic sequence
ctggcagctgcgaa

SEQ ID NO: 785 - DNA, 14 bp, Artificial sequence
  synthetic sequence
gcgaaatcctacca

SEQ ID NO: 786 - DNA, 14 bp, Artificial sequence
  synthetic sequence
atccccagaagtga

SEQ ID NO: 787 - DNA, 14 bp, Artificial sequence
  synthetic sequence
taacaactgagcac

SEQ ID NO: 788 - DNA, 14 bp, Artificial sequence
  synthetic sequence
cgacccaagctggt

SEQ ID NO: 789 - DNA, 14 bp, Artificial sequence
  synthetic sequence
gcagggggataatg

SEQ ID NO: 790 - DNA, 14 bp, Artificial sequence
  synthetic sequence
gggagtcggcctaa

SEQ ID NO: 791 - DNA, 14 bp, Artificial sequence
  synthetic sequence
tatcaagcagaaca

SEQ ID NO: 792 - DNA, 14 bp, Artificial sequence
  synthetic sequence
ccggcaaatacgtg

SEQ ID NO: 793 - DNA, 14 bp, Artificial sequence
  synthetic sequence
ataatagggaagga

SEQ ID NO: 794 - DNA, 14 bp, Artificial sequence
  synthetic sequence
gtgagatggaacgg

SEQ ID NO: 795 - DNA, 14 bp, Artificial sequence
  synthetic sequence
cccagtgagcgggt

SEQ ID NO: 796 - DNA, 14 bp, Artificial sequence
  synthetic sequence
aaatgctggggccg

SEQ ID NO: 797 - DNA, 14 bp, Artificial sequence
  synthetic sequence
atgtggcggccgcg

SEQ ID NO: 798 - DNA, 14 bp, Artificial sequence
  synthetic sequence
tcctccagcccgcc

SEQ ID NO: 799 - DNA, 14 bp, Artificial sequence
  synthetic sequence
acagcataatgcca

SEQ ID NO: 800 - DNA, 14 bp, Artificial sequence
  synthetic sequence
tggcgagacctcgg

SEQ ID NO: 801 - DNA, 14 bp, Artificial sequence
  synthetic sequence
gatagacagtgggg

SEQ ID NO: 802 - DNA, 14 bp, Artificial sequence
  synthetic sequence
ggacccgttgacgg

SEQ ID NO: 803 - DNA, 14 bp, Artificial sequence
  synthetic sequence
ggatggaaatgaca

SEQ ID NO: 804 - DNA, 14 bp, Artificial sequence
  synthetic sequence
cctaccacacggtc

SEQ ID NO: 805 - DNA, 14 bp, Artificial sequence
  synthetic sequence
aacggaagagagtt

SEQ ID NO: 806 - DNA, 14 bp, Artificial sequence
  synthetic sequence
gagtacgtgaccac

SEQ ID NO: 807 - DNA, 14 bp, Artificial sequence
  synthetic sequence
gagactgcgactcc

SEQ ID NO: 808 - DNA, 14 bp, Artificial sequence
  synthetic sequence
ccctgcgcacgtcg

SEQ ID NO: 809 - DNA, 14 bp, Artificial sequence
  synthetic sequence
ggtggagaaagaat

SEQ ID NO: 810 - DNA, 14 bp, Artificial sequence
  synthetic sequence
gtaacgtcagcgcc

SEQ ID NO: 811 - DNA, 14 bp, Artificial sequence
  synthetic sequence
gggcaggcatataa

SEQ ID NO: 812 - DNA, 14 bp, Artificial sequence
  synthetic sequence
gcagcggatctgag

SEQ ID NO: 813 - DNA, 14 bp, Artificial sequence
  synthetic sequence
ctgactcgggcgga

SEQ ID NO: 814 - DNA, 14 bp, Artificial sequence
  synthetic sequence
ctgacctgcaaagc

SEQ ID NO: 815 - DNA, 14 bp, Artificial sequence
  synthetic sequence
gggcaattggacca

SEQ ID NO: 816 - DNA, 14 bp, Artificial sequence
  synthetic sequence
cccggaatatgcgg

SEQ ID NO: 817 - DNA, 14 bp, Artificial sequence
  synthetic sequence
caatgggtaacaaa

SEQ ID NO: 818 - DNA, 14 bp, Artificial sequence
  synthetic sequence
gaaattgcccgaca

SEQ ID NO: 819 - DNA, 14 bp, Artificial sequence
  synthetic sequence
gggatccatgcaga

SEQ ID NO: 820 - DNA, 14 bp, Artificial sequence
  synthetic sequence
tgccggagaccaat

SEQ ID NO: 821 - DNA, 14 bp, Artificial sequence
  synthetic sequence
tctgaagaaagaga

SEQ ID NO: 822 - DNA, 14 bp, Artificial sequence
  synthetic sequence
gacccgtagggtcg

SEQ ID NO: 823 - DNA, 14 bp, Artificial sequence
  synthetic sequence
ccacttggcagacg

SEQ ID NO: 824 - DNA, 14 bp, Artificial sequence
  synthetic sequence
atctgacgcggcca

SEQ ID NO: 825 - DNA, 14 bp, Artificial sequence
  synthetic sequence
aaggatacggccgt

SEQ ID NO: 826 - DNA, 14 bp, Artificial sequence
  synthetic sequence
acgaaggcctgagt

SEQ ID NO: 827 - DNA, 14 bp, Artificial sequence
  synthetic sequence
ccactcccgatacc

SEQ ID NO: 828 - DNA, 14 bp, Artificial sequence
  synthetic sequence
acgtcccgtaacgg

SEQ ID NO: 829 - DNA, 14 bp, Artificial sequence
  synthetic sequence
aaatctgagcggag

SEQ ID NO: 830 - DNA, 14 bp, Artificial sequence
  synthetic sequence
ccgcgttccccaga

SEQ ID NO: 831 - DNA, 14 bp, Artificial sequence
  synthetic sequence
agagtgctcccgaa

SEQ ID NO: 832 - DNA, 14 bp, Artificial sequence
  synthetic sequence
cgcagcgtcagtcg

SEQ ID NO: 833 - DNA, 14 bp, Artificial sequence
  synthetic sequence
cgcgactctcggcc

SEQ ID NO: 834 - DNA, 14 bp, Artificial sequence
  synthetic sequence
actgtcgaccgggc

SEQ ID NO: 835 - DNA, 14 bp, Artificial sequence
  synthetic sequence
gggggtaagacaat

SEQ ID NO: 836 - DNA, 14 bp, Artificial sequence
  synthetic sequence
caaaacctatgcac

SEQ ID NO: 837 - DNA, 14 bp, Artificial sequence
  synthetic sequence
aaaaagttgcgccg

SEQ ID NO: 838 - DNA, 14 bp, Artificial sequence
  synthetic sequence
aaccggctaggtac

SEQ ID NO: 839 - DNA, 14 bp, Artificial sequence
  synthetic sequence
ggccgtacaagatg

SEQ ID NO: 840 - DNA, 14 bp, Artificial sequence
  synthetic sequence
cgcacctcagtcgc

SEQ ID NO: 841 - DNA, 14 bp, Artificial sequence
  synthetic sequence
agttcagagcgggc

SEQ ID NO: 842 - DNA, 14 bp, Artificial sequence
  synthetic sequence
gcaactgactgcca

SEQ ID NO: 843 - DNA, 14 bp, Artificial sequence
  synthetic sequence
taggcgacactaag

SEQ ID NO: 844 - DNA, 14 bp, Artificial sequence
  synthetic sequence
cctactcgccgaag

SEQ ID NO: 845 - DNA, 14 bp, Artificial sequence
  synthetic sequence
agcgcagatataca

SEQ ID NO: 846 - DNA, 14 bp, Artificial sequence
  synthetic sequence
ggggtaacgctacc

SEQ ID NO: 847 - DNA, 14 bp, Artificial sequence
  synthetic sequence
cagtcatacagaca

SEQ ID NO: 848 - DNA, 14 bp, Artificial sequence
  synthetic sequence
gcttcgccacgcca

SEQ ID NO: 849 - DNA, 14 bp, Artificial sequence
  synthetic sequence
acagcgcgtcggtg

SEQ ID NO: 850 - DNA, 14 bp, Artificial sequence
  synthetic sequence
gagacaaatccgta

SEQ ID NO: 851 - DNA, 14 bp, Artificial sequence
  synthetic sequence
gccagaacggttgg

SEQ ID NO: 852 - DNA, 14 bp, Artificial sequence
  synthetic sequence
ccccacctcgctac

SEQ ID NO: 853 - DNA, 14 bp, Artificial sequence
  synthetic sequence
tcaagactacggcg

SEQ ID NO: 854 - DNA, 14 bp, Artificial sequence
  synthetic sequence
gcggagtaccctgc

SEQ ID NO: 855 - DNA, 14 bp, Artificial sequence
  synthetic sequence
cccatgtcgcaagc

SEQ ID NO: 856 - DNA, 14 bp, Artificial sequence
  synthetic sequence
agcctcggaaatca

SEQ ID NO: 857 - DNA, 14 bp, Artificial sequence
  synthetic sequence
ggcgagatcgataa

SEQ ID NO: 858 - DNA, 14 bp, Artificial sequence
  synthetic sequence
gcttataaacacca

SEQ ID NO: 859 - DNA, 14 bp, Artificial sequence
  synthetic sequence
tggcaggtccccgt

SEQ ID NO: 860 - DNA, 14 bp, Artificial sequence
  synthetic sequence
cgtgtagcaataaa

SEQ ID NO: 861 - DNA, 14 bp, Artificial sequence
  synthetic sequence
atgagactaagtag

SEQ ID NO: 862 - DNA, 14 bp, Artificial sequence
  synthetic sequence
gttgaacctgggaa

SEQ ID NO: 863 - DNA, 14 bp, Artificial sequence
  synthetic sequence
acgcggatcattca

SEQ ID NO: 864 - DNA, 14 bp, Artificial sequence
  synthetic sequence
taggtcagtgagaa

SEQ ID NO: 865 - DNA, 14 bp, Artificial sequence
  synthetic sequence
tttccccgggcggc

SEQ ID NO: 866 - DNA, 14 bp, Artificial sequence
  synthetic sequence
gaccgtttgcgcag

SEQ ID NO: 867 - DNA, 14 bp, Artificial sequence
  synthetic sequence
tcggggacatcagt

SEQ ID NO: 868 - DNA, 14 bp, Artificial sequence
  synthetic sequence
cataccttaggacc

SEQ ID NO: 869 - DNA, 14 bp, Artificial sequence
  synthetic sequence
gcactctgcagtac

SEQ ID NO: 870 - DNA, 14 bp, Artificial sequence
  synthetic sequence
gcctagcgtcgctc

SEQ ID NO: 871 - DNA, 14 bp, Artificial sequence
  synthetic sequence
ctaacggtgtagca

SEQ ID NO: 872 - DNA, 14 bp, Artificial sequence
  synthetic sequence
cgcaaacgtttcaa

SEQ ID NO: 873 - DNA, 14 bp, Artificial sequence
  synthetic sequence
gcaggcgtgatgat

SEQ ID NO: 874 - DNA, 14 bp, Artificial sequence
  synthetic sequence
taacaaacaatggt

SEQ ID NO: 875 - DNA, 14 bp, Artificial sequence
  synthetic sequence
ttccacaaggtcgg

SEQ ID NO: 876 - DNA, 14 bp, Artificial sequence
  synthetic sequence
gagctccctacact

SEQ ID NO: 877 - DNA, 14 bp, Artificial sequence
  synthetic sequence
gtgctacgaacgtc

SEQ ID NO: 878 - DNA, 14 bp, Artificial sequence
  synthetic sequence
gttcccgctaccac

SEQ ID NO: 879 - DNA, 14 bp, Artificial sequence
  synthetic sequence
ccccaatagtctcc

SEQ ID NO: 880 - DNA, 14 bp, Artificial sequence
  synthetic sequence
agtaggaagatcgt

SEQ ID NO: 881 - DNA, 14 bp, Artificial sequence
  synthetic sequence
gacgccttgcgcta

SEQ ID NO: 882 - DNA, 14 bp, Artificial sequence
  synthetic sequence
tcgatccacgcaat

SEQ ID NO: 883 - DNA, 14 bp, Artificial sequence
  synthetic sequence
tgctgcgaagtccg

SEQ ID NO: 884 - DNA, 14 bp, Artificial sequence
  synthetic sequence
tatccatgaccaga

SEQ ID NO: 885 - DNA, 14 bp, Artificial sequence
  synthetic sequence
ggaagattatccca

SEQ ID NO: 886 - DNA, 14 bp, Artificial sequence
  synthetic sequence
taacgggcattaca

SEQ ID NO: 887 - DNA, 14 bp, Artificial sequence
  synthetic sequence
ctggggagcctcta

SEQ ID NO: 888 - DNA, 14 bp, Artificial sequence
  synthetic sequence
actaaatagggctc

SEQ ID NO: 889 - DNA, 14 bp, Artificial sequence
  synthetic sequence
ttcccgcaatcgac

SEQ ID NO: 890 - DNA, 14 bp, Artificial sequence
  synthetic sequence
tgaccccctagcgt

SEQ ID NO: 891 - DNA, 14 bp, Artificial sequence
  synthetic sequence
atgtccaggcgcta

SEQ ID NO: 892 - DNA, 14 bp, Artificial sequence
  synthetic sequence
ccagatcccccttg

SEQ ID NO: 893 - DNA, 14 bp, Artificial sequence
  synthetic sequence
cgtggacggttaga

SEQ ID NO: 894 - DNA, 14 bp, Artificial sequence
  synthetic sequence
tccctggctcgcaa

SEQ ID NO: 895 - DNA, 14 bp, Artificial sequence
  synthetic sequence
atacaccgtatgac

SEQ ID NO: 896 - DNA, 14 bp, Artificial sequence
  synthetic sequence
acgattaccacctc

SEQ ID NO: 897 - DNA, 14 bp, Artificial sequence
  synthetic sequence
agtaatagcataca

SEQ ID NO: 898 - DNA, 14 bp, Artificial sequence
  synthetic sequence
gaaggtctgactac

SEQ ID NO: 899 - DNA, 14 bp, Artificial sequence
  synthetic sequence
tggccaggtgctaa

SEQ ID NO: 900 - DNA, 14 bp, Artificial sequence
  synthetic sequence
atgtggcgaatcca

SEQ ID NO: 901 - DNA, 14 bp, Artificial sequence
  synthetic sequence
ggccttcagagtca

SEQ ID NO: 902 - DNA, 14 bp, Artificial sequence
  synthetic sequence
cccacgcgtcaatt

SEQ ID NO: 903 - DNA, 14 bp, Artificial sequence
  synthetic sequence
ccatagacgcggtt

SEQ ID NO: 904 - DNA, 14 bp, Artificial sequence
  synthetic sequence
ttcacaaacacaat

SEQ ID NO: 905 - DNA, 14 bp, Artificial sequence
  synthetic sequence
agctattcacccaa

SEQ ID NO: 906 - DNA, 14 bp, Artificial sequence
  synthetic sequence
tcggggtaaacata

SEQ ID NO: 907 - DNA, 14 bp, Artificial sequence
  synthetic sequence
ctggggctgctacg

SEQ ID NO: 908 - DNA, 14 bp, Artificial sequence
  synthetic sequence
cgctgatgtggcaa

SEQ ID NO: 909 - DNA, 14 bp, Artificial sequence
  synthetic sequence
cgtccctgtcgccc

SEQ ID NO: 910 - DNA, 14 bp, Artificial sequence
  synthetic sequence
ttgagagtgacccg

SEQ ID NO: 911 - DNA, 14 bp, Artificial sequence
  synthetic sequence
caagaattacaagt

SEQ ID NO: 912 - DNA, 14 bp, Artificial sequence
  synthetic sequence
atgacgggtcgtcc

SEQ ID NO: 913 - DNA, 14 bp, Artificial sequence
  synthetic sequence
tcttgcaaacccaa

SEQ ID NO: 914 - DNA, 14 bp, Artificial sequence
  synthetic sequence
attggagtgggcag

SEQ ID NO: 915 - DNA, 14 bp, Artificial sequence
  synthetic sequence
acgaggtcgctggt

SEQ ID NO: 916 - DNA, 14 bp, Artificial sequence
  synthetic sequence
ggcagtacacctat

SEQ ID NO: 917 - DNA, 14 bp, Artificial sequence
  synthetic sequence
tctcggacgtaacc

SEQ ID NO: 918 - DNA, 14 bp, Artificial sequence
  synthetic sequence
gctgctgtccccgg

SEQ ID NO: 919 - DNA, 14 bp, Artificial sequence
  synthetic sequence
aggtggatacgcgt

SEQ ID NO: 920 - DNA, 14 bp, Artificial sequence
  synthetic sequence
cgtcgtagagatac

SEQ ID NO: 921 - DNA, 14 bp, Artificial sequence
  synthetic sequence
gtaacacgcctcat

SEQ ID NO: 922 - DNA, 14 bp, Artificial sequence
  synthetic sequence
cgaactacgaactt

SEQ ID NO: 923 - DNA, 14 bp, Artificial sequence
  synthetic sequence
taagcaagttcacg

SEQ ID NO: 924 - DNA, 14 bp, Artificial sequence
  synthetic sequence
acaggtgcgcgtta

SEQ ID NO: 925 - DNA, 14 bp, Artificial sequence
  synthetic sequence
cacctgcctaaata

SEQ ID NO: 926 - DNA, 14 bp, Artificial sequence
  synthetic sequence
cgccagcagtggtt

SEQ ID NO: 927 - DNA, 14 bp, Artificial sequence
  synthetic sequence
gtgagatactcggc

SEQ ID NO: 928 - DNA, 14 bp, Artificial sequence
  synthetic sequence
tgccagctaaactc

SEQ ID NO: 929 - DNA, 14 bp, Artificial sequence
  synthetic sequence
ctgaactcagctgc

SEQ ID NO: 930 - DNA, 14 bp, Artificial sequence
  synthetic sequence
attgtccacggaag

SEQ ID NO: 931 - DNA, 14 bp, Artificial sequence
  synthetic sequence
atcgtcgtaggcgg

SEQ ID NO: 932 - DNA, 14 bp, Artificial sequence
  synthetic sequence
cctgggcatccgta

SEQ ID NO: 933 - DNA, 14 bp, Artificial sequence
  synthetic sequence
cgtccaagaccatt

SEQ ID NO: 934 - DNA, 14 bp, Artificial sequence
  synthetic sequence
cgggtcttccgcca

SEQ ID NO: 935 - DNA, 14 bp, Artificial sequence
  synthetic sequence
gatggtgagaacta

SEQ ID NO: 936 - DNA, 14 bp, Artificial sequence
  synthetic sequence
ccataactaggcta

SEQ ID NO: 937 - DNA, 14 bp, Artificial sequence
  synthetic sequence
tagaaggcttcgaa

SEQ ID NO: 938 - DNA, 14 bp, Artificial sequence
  synthetic sequence
cacgaatgtgcact

SEQ ID NO: 939 - DNA, 14 bp, Artificial sequence
  synthetic sequence
gtaaactgatacag

SEQ ID NO: 940 - DNA, 14 bp, Artificial sequence
  synthetic sequence
tgtcacataaggca

SEQ ID NO: 941 - DNA, 14 bp, Artificial sequence
  synthetic sequence
cccgtaaccttggc

SEQ ID NO: 942 - DNA, 14 bp, Artificial sequence
  synthetic sequence
aaaagtggcattcc

SEQ ID NO: 943 - DNA, 14 bp, Artificial sequence
  synthetic sequence
gactggatcatcaa

SEQ ID NO: 944 - DNA, 14 bp, Artificial sequence
  synthetic sequence
taccgatgtccccc

SEQ ID NO: 945 - DNA, 14 bp, Artificial sequence
  synthetic sequence
gagagtataaactg

SEQ ID NO: 946 - DNA, 14 bp, Artificial sequence
  synthetic sequence
acaagtgcgtctag

SEQ ID NO: 947 - DNA, 14 bp, Artificial sequence
  synthetic sequence
gtcctgagagtcaa

SEQ ID NO: 948 - DNA, 14 bp, Artificial sequence
  synthetic sequence
gaatcgctgtgacg

SEQ ID NO: 949 - DNA, 14 bp, Artificial sequence
  synthetic sequence
attagggaagtaaa

SEQ ID NO: 950 - DNA, 14 bp, Artificial sequence
  synthetic sequence
gcctagtcaatcaa

SEQ ID NO: 951 - DNA, 14 bp, Artificial sequence
  synthetic sequence
atgcgtacagtgca

SEQ ID NO: 952 - DNA, 14 bp, Artificial sequence
  synthetic sequence
aataagtgatgaac

SEQ ID NO: 953 - DNA, 14 bp, Artificial sequence
  synthetic sequence
taacactactaaga

SEQ ID NO: 954 - DNA, 14 bp, Artificial sequence
  synthetic sequence
gaggactgtagatg

SEQ ID NO: 955 - DNA, 14 bp, Artificial sequence
  synthetic sequence
atactaaatgcagg

SEQ ID NO: 956 - DNA, 14 bp, Artificial sequence
  synthetic sequence
cgacttaaaaactc

SEQ ID NO: 957 - DNA, 14 bp, Artificial sequence
  synthetic sequence
ttaacccaggtaac

SEQ ID NO: 958 - DNA, 14 bp, Artificial sequence
  synthetic sequence
ccgctaataatagc

SEQ ID NO: 959 - DNA, 14 bp, Artificial sequence
  synthetic sequence
ccggcaatgggtgt

SEQ ID NO: 960 - DNA, 14 bp, Artificial sequence
  synthetic sequence
cgttaaagtaaacg

SEQ ID NO: 961 - DNA, 14 bp, Artificial sequence
  synthetic sequence
gcctaagctacgat

SEQ ID NO: 962 - DNA, 14 bp, Artificial sequence
  synthetic sequence
acagcggctatatc

SEQ ID NO: 963 - DNA, 14 bp, Artificial sequence
  synthetic sequence
tgataacagtcgac

SEQ ID NO: 964 - DNA, 14 bp, Artificial sequence
  synthetic sequence
agggctctctccag

SEQ ID NO: 965 - DNA, 14 bp, Artificial sequence
  synthetic sequence
cagggaggagtctt

SEQ ID NO: 966 - DNA, 14 bp, Artificial sequence
  synthetic sequence
gcgatgtccgactg

SEQ ID NO: 967 - DNA, 14 bp, Artificial sequence
  synthetic sequence
gagcctcctctaaa

SEQ ID NO: 968 - DNA, 14 bp, Artificial sequence
  synthetic sequence
atgagtaagctaac

SEQ ID NO: 969 - DNA, 14 bp, Artificial sequence
  synthetic sequence
cacaaggcaatctt

SEQ ID NO: 970 - DNA, 14 bp, Artificial sequence
  synthetic sequence
tcaatcccccacta

SEQ ID NO: 971 - DNA, 14 bp, Artificial sequence
  synthetic sequence
cgaattctcggacg

SEQ ID NO: 972 - DNA, 14 bp, Artificial sequence
  synthetic sequence
ggactccttgggcg

SEQ ID NO: 973 - DNA, 14 bp, Artificial sequence
  synthetic sequence
caaattaggcctag

SEQ ID NO: 974 - DNA, 14 bp, Artificial sequence
  synthetic sequence
ccatcagtctgcga

SEQ ID NO: 975 - DNA, 14 bp, Artificial sequence
  synthetic sequence
ccatttgggaaagc

SEQ ID NO: 976 - DNA, 14 bp, Artificial sequence
  synthetic sequence
ggagtaaagctgta

SEQ ID NO: 977 - DNA, 14 bp, Artificial sequence
  synthetic sequence
cctcccgaaattgc

SEQ ID NO: 978 - DNA, 14 bp, Artificial sequence
  synthetic sequence
tgagaggacctgta

SEQ ID NO: 979 - DNA, 14 bp, Artificial sequence
  synthetic sequence
atacgctgccgctc

SEQ ID NO: 980 - DNA, 14 bp, Artificial sequence
  synthetic sequence
tcacccgattcaca

SEQ ID NO: 981 - DNA, 14 bp, Artificial sequence
  synthetic sequence
agctagcctgggta

SEQ ID NO: 982 - DNA, 14 bp, Artificial sequence
  synthetic sequence
aatagcgatccatg

SEQ ID NO: 983 - DNA, 14 bp, Artificial sequence
  synthetic sequence
atcccgcatgaatg

SEQ ID NO: 984 - DNA, 14 bp, Artificial sequence
  synthetic sequence
gtcaatgctcggac

SEQ ID NO: 985 - DNA, 14 bp, Artificial sequence
  synthetic sequence
cgatacgtgtccaa

SEQ ID NO: 986 - DNA, 14 bp, Artificial sequence
  synthetic sequence
cagtatgtgggggc

SEQ ID NO: 987 - DNA, 14 bp, Artificial sequence
  synthetic sequence
acattggcgaagtc

SEQ ID NO: 988 - DNA, 14 bp, Artificial sequence
  synthetic sequence
taaagatcctacga

SEQ ID NO: 989 - DNA, 14 bp, Artificial sequence
  synthetic sequence
ctattaagaccgaa

SEQ ID NO: 990 - DNA, 14 bp, Artificial sequence
  synthetic sequence
acgtccatcgatgg

SEQ ID NO: 991 - DNA, 14 bp, Artificial sequence
  synthetic sequence
tcaataatcgaagg

SEQ ID NO: 992 - DNA, 14 bp, Artificial sequence
  synthetic sequence
gtccatatcgcccg

SEQ ID NO: 993 - DNA, 14 bp, Artificial sequence
  synthetic sequence
gacttcacatgggc

SEQ ID NO: 994 - DNA, 14 bp, Artificial sequence
  synthetic sequence
cacgggtgttcgaa

SEQ ID NO: 995 - DNA, 14 bp, Artificial sequence
  synthetic sequence
aagttctcggcaac

SEQ ID NO: 996 - DNA, 14 bp, Artificial sequence
  synthetic sequence
gcggtagtataccc

SEQ ID NO: 997 - DNA, 14 bp, Artificial sequence
  synthetic sequence
gtaagtgacaaata

SEQ ID NO: 998 - DNA, 14 bp, Artificial sequence
  synthetic sequence
cattagaggtccgg

SEQ ID NO: 999 - DNA, 14 bp, Artificial sequence
  synthetic sequence
cactgccattcgca

SEQ ID NO: 1000 - DNA, 14 bp, Artificial sequence
  synthetic sequence
gcaccgtcctaatc

SEQ ID NO: 1001 - DNA, 14 bp, Artificial sequence
  synthetic sequence
cctgtgccacgggt

SEQ ID NO: 1002 - DNA, 14 bp, Artificial sequence
  synthetic sequence
aagagcgctgctta

SEQ ID NO: 1003 - DNA, 14 bp, Artificial sequence
  synthetic sequence
gtgggcataccgat

SEQ ID NO: 1004 - DNA, 14 bp, Artificial sequence
  synthetic sequence
ctttcccaccacgc

SEQ ID NO: 1005 - DNA, 14 bp, Artificial sequence
  synthetic sequence
attcgtgaaaaaag

SEQ ID NO: 1006 - DNA, 14 bp, Artificial sequence
  synthetic sequence
aagacttggcctgc

SEQ ID NO: 1007 - DNA, 14 bp, Artificial sequence
  synthetic sequence
atgtgcacgcaact

SEQ ID NO: 1008 - DNA, 14 bp, Artificial sequence
  synthetic sequence
aataatgctcacca

SEQ ID NO: 1009 - DNA, 14 bp, Artificial sequence
  synthetic sequence
gcacagttaggcct

SEQ ID NO: 1010 - DNA, 14 bp, Artificial sequence
  synthetic sequence
aaaatctacatgcg

SEQ ID NO: 1011 - DNA, 14 bp, Artificial sequence
  synthetic sequence
aagaaatggtgtcc

SEQ ID NO: 1012 - DNA, 14 bp, Artificial sequence
  synthetic sequence
acacgccagcgttt

SEQ ID NO: 1013 - DNA, 14 bp, Artificial sequence
  synthetic sequence
ctgaaattcgcgca

SEQ ID NO: 1014 - DNA, 14 bp, Artificial sequence
  synthetic sequence
cgatcagatccagt

SEQ ID NO: 1015 - DNA, 14 bp, Artificial sequence
  synthetic sequence
aggtgaaatcgtcc

SEQ ID NO: 1016 - DNA, 14 bp, Artificial sequence
  synthetic sequence
tagaaaggagaatt

SEQ ID NO: 1017 - DNA, 14 bp, Artificial sequence
  synthetic sequence
agcccgttggatac

SEQ ID NO: 1018 - DNA, 14 bp, Artificial sequence
  synthetic sequence
ccgtctacctgccc

SEQ ID NO: 1019 - DNA, 14 bp, Artificial sequence
  synthetic sequence
caagagtttccggg

SEQ ID NO: 1020 - DNA, 14 bp, Artificial sequence
  synthetic sequence
gatcgctgaagtcg

SEQ ID NO: 1021 - DNA, 14 bp, Artificial sequence
  synthetic sequence
gcggtcaagggtta

SEQ ID NO: 1022 - DNA, 14 bp, Artificial sequence
  synthetic sequence
acactttggagggg

SEQ ID NO: 1023 - DNA, 14 bp, Artificial sequence
  synthetic sequence
tagcatagaacgct

SEQ ID NO: 1024 - DNA, 14 bp, Artificial sequence
  synthetic sequence
gaccgtagtaagct

SEQ ID NO: 1025 - DNA, 14 bp, Artificial sequence
  synthetic sequence
tacggggttagagg

SEQ ID NO: 1026 - DNA, 14 bp, Artificial sequence
  synthetic sequence
gcacctaggcggtt

SEQ ID NO: 1027 - DNA, 14 bp, Artificial sequence
  synthetic sequence
aaaccgtaccgtta

SEQ ID NO: 1028 - DNA, 14 bp, Artificial sequence
  synthetic sequence
cggggtgtacctac

SEQ ID NO: 1029 - DNA, 14 bp, Artificial sequence
  synthetic sequence
ggcgcatttccgaa

SEQ ID NO: 1030 - DNA, 14 bp, Artificial sequence
  synthetic sequence
ggggtgggcaatct

SEQ ID NO: 1031 - DNA, 14 bp, Artificial sequence
  synthetic sequence
tcgcggtctacgac

SEQ ID NO: 1032 - DNA, 14 bp, Artificial sequence
  synthetic sequence
tcccaactataacg

SEQ ID NO: 1033 - DNA, 14 bp, Artificial sequence
  synthetic sequence
tgtcacacgccatc

SEQ ID NO: 1034 - DNA, 14 bp, Artificial sequence
  synthetic sequence
agtgctcaagaggt

SEQ ID NO: 1035 - DNA, 14 bp, Artificial sequence
  synthetic sequence
tcccggagtagatg

SEQ ID NO: 1036 - DNA, 14 bp, Artificial sequence
  synthetic sequence
agctcccgtaggtc

SEQ ID NO: 1037 - DNA, 14 bp, Artificial sequence
  synthetic sequence
cctgcctcgctagg

SEQ ID NO: 1038 - DNA, 14 bp, Artificial sequence
  synthetic sequence
tttcccaagcgcca

SEQ ID NO: 1039 - DNA, 14 bp, Artificial sequence
  synthetic sequence
tccacagtgcgtcg

SEQ ID NO: 1040 - DNA, 14 bp, Artificial sequence
  synthetic sequence
acggctggttggag

SEQ ID NO: 1041 - DNA, 14 bp, Artificial sequence
  synthetic sequence
gctccaagatctgg

SEQ ID NO: 1042 - DNA, 14 bp, Artificial sequence
  synthetic sequence
accgaatgacaatt

SEQ ID NO: 1043 - DNA, 14 bp, Artificial sequence
  synthetic sequence
tagagcaaacagtt

SEQ ID NO: 1044 - DNA, 14 bp, Artificial sequence
  synthetic sequence
ggggtcgtcgtgaa

SEQ ID NO: 1045 - DNA, 14 bp, Artificial sequence
  synthetic sequence
gggggaccagattt

SEQ ID NO: 1046 - DNA, 14 bp, Artificial sequence
  synthetic sequence
tcagtcacagtgca

SEQ ID NO: 1047 - DNA, 14 bp, Artificial sequence
  synthetic sequence
ccttccgtagccgg

SEQ ID NO: 1048 - DNA, 14 bp, Artificial sequence
  synthetic sequence
cgtactcccactca

SEQ ID NO: 1049 - DNA, 14 bp, Artificial sequence
  synthetic sequence
gtaggctgaacgta

SEQ ID NO: 1050 - DNA, 14 bp, Artificial sequence
  synthetic sequence
gcctagaccttacg

SEQ ID NO: 1051 - DNA, 14 bp, Artificial sequence
  synthetic sequence
aacaatcatcctag

SEQ ID NO: 1052 - DNA, 14 bp, Artificial sequence
  synthetic sequence
tatctacccggcgg

SEQ ID NO: 1053 - DNA, 14 bp, Artificial sequence
  synthetic sequence
ggggagcctcttac

SEQ ID NO: 1054 - DNA, 14 bp, Artificial sequence
  synthetic sequence
aaagaaccgacttt

SEQ ID NO: 1055 - DNA, 14 bp, Artificial sequence
  synthetic sequence
tagagtctggaaga

SEQ ID NO: 1056 - DNA, 14 bp, Artificial sequence
  synthetic sequence
gttagactagagcc

SEQ ID NO: 1057 - DNA, 14 bp, Artificial sequence
  synthetic sequence
atcgtccagcgcct

SEQ ID NO: 1058 - DNA, 14 bp, Artificial sequence
  synthetic sequence
cgggcatcatcatc

SEQ ID NO: 1059 - DNA, 14 bp, Artificial sequence
  synthetic sequence
atatggaagaatgc

SEQ ID NO: 1060 - DNA, 14 bp, Artificial sequence
  synthetic sequence
ctgtgagggtggac

SEQ ID NO: 1061 - DNA, 14 bp, Artificial sequence
  synthetic sequence
tggagttacagggc

SEQ ID NO: 1062 - DNA, 14 bp, Artificial sequence
  synthetic sequence
ggccaggttccact

SEQ ID NO: 1063 - DNA, 14 bp, Artificial sequence
  synthetic sequence
aggagatgtccata

SEQ ID NO: 1064 - DNA, 14 bp, Artificial sequence
  synthetic sequence
gctcgtgatgaaac

SEQ ID NO: 1065 - DNA, 14 bp, Artificial sequence
  synthetic sequence
gcacgcgattgtag

SEQ ID NO: 1066 - DNA, 14 bp, Artificial sequence
  synthetic sequence
acaccaacacattt

SEQ ID NO: 1067 - DNA, 14 bp, Artificial sequence
  synthetic sequence
gcgagcctcccttc

SEQ ID NO: 1068 - DNA, 14 bp, Artificial sequence
  synthetic sequence
gttcgtcaccccgc

SEQ ID NO: 1069 - DNA, 14 bp, Artificial sequence
  synthetic sequence
ataccccgtacatg

SEQ ID NO: 1070 - DNA, 14 bp, Artificial sequence
  synthetic sequence
cgtccctcgtcgag

SEQ ID NO: 1071 - DNA, 14 bp, Artificial sequence
  synthetic sequence
ataaaacacccttc

SEQ ID NO: 1072 - DNA, 14 bp, Artificial sequence
  synthetic sequence
catttgccgcaaca

SEQ ID NO: 1073 - DNA, 14 bp, Artificial sequence
  synthetic sequence
caactttaacaaac

SEQ ID NO: 1074 - DNA, 14 bp, Artificial sequence
  synthetic sequence
cggtgctgccatgc

SEQ ID NO: 1075 - DNA, 14 bp, Artificial sequence
  synthetic sequence
atgcgcattcggag

SEQ ID NO: 1076 - DNA, 14 bp, Artificial sequence
  synthetic sequence
cacgaatacattga

SEQ ID NO: 1077 - DNA, 14 bp, Artificial sequence
  synthetic sequence
aacgtcactcagtg

SEQ ID NO: 1078 - DNA, 14 bp, Artificial sequence
  synthetic sequence
aaattgcaacggtg

SEQ ID NO: 1079 - DNA, 14 bp, Artificial sequence
  synthetic sequence
gacgacgaacttct

SEQ ID NO: 1080 - DNA, 14 bp, Artificial sequence
  synthetic sequence
acgtgcctgtgaac

SEQ ID NO: 1081 - DNA, 14 bp, Artificial sequence
  synthetic sequence
tccgcagctgcgct

SEQ ID NO: 1082 - DNA, 14 bp, Artificial sequence
  synthetic sequence
agaggttatacgca

SEQ ID NO: 1083 - DNA, 14 bp, Artificial sequence
  synthetic sequence
aacaaaaatagctt

SEQ ID NO: 1084 - DNA, 14 bp, Artificial sequence
  synthetic sequence
tgggagatagtcaa

SEQ ID NO: 1085 - DNA, 14 bp, Artificial sequence
  synthetic sequence
atgcgcgattcacc

SEQ ID NO: 1086 - DNA, 14 bp, Artificial sequence
  synthetic sequence
gtatagggctcccg

SEQ ID NO: 1087 - DNA, 14 bp, Artificial sequence
  synthetic sequence
gaccaggcgtattg

SEQ ID NO: 1088 - DNA, 14 bp, Artificial sequence
  synthetic sequence
accaacctcgcgtt

SEQ ID NO: 1089 - DNA, 14 bp, Artificial sequence
  synthetic sequence
aacaagtagtgcta

SEQ ID NO: 1090 - DNA, 14 bp, Artificial sequence
  synthetic sequence
tgtaacaacactaa

SEQ ID NO: 1091 - DNA, 14 bp, Artificial sequence
  synthetic sequence
tgagtcgaggcata

SEQ ID NO: 1092 - DNA, 14 bp, Artificial sequence
  synthetic sequence
ccgacaagcttggt

SEQ ID NO: 1093 - DNA, 14 bp, Artificial sequence
  synthetic sequence
cgttaagccggtgg

SEQ ID NO: 1094 - DNA, 14 bp, Artificial sequence
  synthetic sequence
ctcccacaagcatt

SEQ ID NO: 1095 - DNA, 14 bp, Artificial sequence
  synthetic sequence
gggttaagaggtgc

SEQ ID NO: 1096 - DNA, 14 bp, Artificial sequence
  synthetic sequence
gagcccgtttcccg

SEQ ID NO: 1097 - DNA, 14 bp, Artificial sequence
  synthetic sequence
accgacgtaatggt

SEQ ID NO: 1098 - DNA, 14 bp, Artificial sequence
  synthetic sequence
aggcaattgaccgt

SEQ ID NO: 1099 - DNA, 14 bp, Artificial sequence
  synthetic sequence
atctacccctgagg

SEQ ID NO: 1100 - DNA, 14 bp, Artificial sequence
  synthetic sequence
gttgaactgcgaga

SEQ ID NO: 1101 - DNA, 14 bp, Artificial sequence
  synthetic sequence
ggatcgtcatgagc

SEQ ID NO: 1102 - DNA, 14 bp, Artificial sequence
  synthetic sequence
tgaaaccatgggat

SEQ ID NO: 1103 - DNA, 14 bp, Artificial sequence
  synthetic sequence
agaccgcgtcgtgt

SEQ ID NO: 1104 - DNA, 14 bp, Artificial sequence
  synthetic sequence
tagcgagctgccgt

SEQ ID NO: 1105 - DNA, 14 bp, Artificial sequence
  synthetic sequence
ataaggtacacgtc

SEQ ID NO: 1106 - DNA, 14 bp, Artificial sequence
  synthetic sequence
gcggcaccactatt

SEQ ID NO: 1107 - DNA, 14 bp, Artificial sequence
  synthetic sequence
ttggtggggagaac

SEQ ID NO: 1108 - DNA, 14 bp, Artificial sequence
  synthetic sequence
gctctctaaaggga

SEQ ID NO: 1109 - DNA, 14 bp, Artificial sequence
  synthetic sequence
ctgtacgtaaaagg

SEQ ID NO: 1110 - DNA, 14 bp, Artificial sequence
  synthetic sequence
agctcccgaatcgt

SEQ ID NO: 1111 - DNA, 14 bp, Artificial sequence
  synthetic sequence
aatgtacccgagtc

SEQ ID NO: 1112 - DNA, 14 bp, Artificial sequence
  synthetic sequence
gcttcgtcgcccag

SEQ ID NO: 1113 - DNA, 14 bp, Artificial sequence
  synthetic sequence
gtagaagactggtg

SEQ ID NO: 1114 - DNA, 14 bp, Artificial sequence
  synthetic sequence
ccacatgagattcc

SEQ ID NO: 1115 - DNA, 14 bp, Artificial sequence
  synthetic sequence
catcttgcgcccac

SEQ ID NO: 1116 - DNA, 14 bp, Artificial sequence
  synthetic sequence
gccataatctgcgc

SEQ ID NO: 1117 - DNA, 14 bp, Artificial sequence
  synthetic sequence
cggcctcgatggta

SEQ ID NO: 1118 - DNA, 14 bp, Artificial sequence
  synthetic sequence
ggtcgtgcgtggac

SEQ ID NO: 1119 - DNA, 14 bp, Artificial sequence
  synthetic sequence
gactgcctcgtaac

SEQ ID NO: 1120 - DNA, 14 bp, Artificial sequence
  synthetic sequence
cgcctataaacctg

SEQ ID NO: 1121 - DNA, 14 bp, Artificial sequence
  synthetic sequence
tgaccctgatcgac

SEQ ID NO: 1122 - DNA, 14 bp, Artificial sequence
  synthetic sequence
actctcgccgagtg

SEQ ID NO: 1123 - DNA, 14 bp, Artificial sequence
  synthetic sequence
cggtttcaaccggg

SEQ ID NO: 1124 - DNA, 14 bp, Artificial sequence
  synthetic sequence
ttgaacgagaaggt

SEQ ID NO: 1125 - DNA, 14 bp, Artificial sequence
  synthetic sequence
gacggctatacaat

SEQ ID NO: 1126 - DNA, 14 bp, Artificial sequence
  synthetic sequence
ttgctggcgccgag

SEQ ID NO: 1127 - DNA, 14 bp, Artificial sequence
  synthetic sequence
acactggcttgacc

SEQ ID NO: 1128 - DNA, 14 bp, Artificial sequence
  synthetic sequence
actgcactcactaa

SEQ ID NO: 1129 - DNA, 14 bp, Artificial sequence
  synthetic sequence
aatgctaggtaggg

SEQ ID NO: 1130 - DNA, 14 bp, Artificial sequence
  synthetic sequence
aataacgattggag

SEQ ID NO: 1131 - DNA, 14 bp, Artificial sequence
  synthetic sequence
cgcatgtgaggcgt

SEQ ID NO: 1132 - DNA, 14 bp, Artificial sequence
  synthetic sequence
gccgaggtcgctct

SEQ ID NO: 1133 - DNA, 14 bp, Artificial sequence
  synthetic sequence
actccagttccagg

SEQ ID NO: 1134 - DNA, 14 bp, Artificial sequence
  synthetic sequence
catcatgggctgag

SEQ ID NO: 1135 - DNA, 14 bp, Artificial sequence
  synthetic sequence
gatagacattaacc

SEQ ID NO: 1136 - DNA, 14 bp, Artificial sequence
  synthetic sequence
tggtggactccaca

SEQ ID NO: 1137 - DNA, 14 bp, Artificial sequence
  synthetic sequence
cagcaccaatcctt

SEQ ID NO: 1138 - DNA, 14 bp, Artificial sequence
  synthetic sequence
gacttaagcgtggc

SEQ ID NO: 1139 - DNA, 14 bp, Artificial sequence
  synthetic sequence
acctacgaagggtt

SEQ ID NO: 1140 - DNA, 14 bp, Artificial sequence
  synthetic sequence
acctatagtgagag

SEQ ID NO: 1141 - DNA, 14 bp, Artificial sequence
  synthetic sequence
ctctgcgagtcccg

SEQ ID NO: 1142 - DNA, 14 bp, Artificial sequence
  synthetic sequence
tcaagacattggga

SEQ ID NO: 1143 - DNA, 14 bp, Artificial sequence
  synthetic sequence
accctggccgtatc

SEQ ID NO: 1144 - DNA, 14 bp, Artificial sequence
  synthetic sequence
gtgagtcagtcccg

SEQ ID NO: 1145 - DNA, 14 bp, Artificial sequence
  synthetic sequence
aagacccgtagctt

SEQ ID NO: 1146 - DNA, 14 bp, Artificial sequence
  synthetic sequence
gagattgcgtccaa

SEQ ID NO: 1147 - DNA, 14 bp, Artificial sequence
  synthetic sequence
cgaggttgtgaggg

SEQ ID NO: 1148 - DNA, 14 bp, Artificial sequence
  synthetic sequence
aggtaaccacttca

SEQ ID NO: 1149 - DNA, 14 bp, Artificial sequence
  synthetic sequence
ggtagtcatagccc

SEQ ID NO: 1150 - DNA, 14 bp, Artificial sequence
  synthetic sequence
ggggctagattagc

SEQ ID NO: 1151 - DNA, 14 bp, Artificial sequence
  synthetic sequence
tgcagattgccggg

SEQ ID NO: 1152 - DNA, 14 bp, Artificial sequence
  synthetic sequence
acaatgttgcgaga

SEQ ID NO: 1153 - DNA, 14 bp, Artificial sequence
  synthetic sequence
actagacatacaat

SEQ ID NO: 1154 - DNA, 14 bp, Artificial sequence
  synthetic sequence
gactctagatagag

SEQ ID NO: 1155 - DNA, 14 bp, Artificial sequence
  synthetic sequence
gacaaatgaaagtt

SEQ ID NO: 1156 - DNA, 14 bp, Artificial sequence
  synthetic sequence
caaagagtgataat

SEQ ID NO: 1157 - DNA, 14 bp, Artificial sequence
  synthetic sequence
catcgtatcggcaa

SEQ ID NO: 1158 - DNA, 14 bp, Artificial sequence
  synthetic sequence
ccgccactctgtgc

SEQ ID NO: 1159 - DNA, 14 bp, Artificial sequence
  synthetic sequence
ggcgacgtccaatt

SEQ ID NO: 1160 - DNA, 14 bp, Artificial sequence
  synthetic sequence
cgaggcctccatat

SEQ ID NO: 1161 - DNA, 14 bp, Artificial sequence
  synthetic sequence
ccctgtacgtccaa

SEQ ID NO: 1162 - DNA, 14 bp, Artificial sequence
  synthetic sequence
cgtacctaaacgtc

SEQ ID NO: 1163 - DNA, 14 bp, Artificial sequence
  synthetic sequence
ggtgagcgcacttg

SEQ ID NO: 1164 - DNA, 14 bp, Artificial sequence
  synthetic sequence
cttatgcgccagag

SEQ ID NO: 1165 - DNA, 14 bp, Artificial sequence
  synthetic sequence
atcgaacgctataa

SEQ ID NO: 1166 - DNA, 14 bp, Artificial sequence
  synthetic sequence
cggtgatagtcgag

SEQ ID NO: 1167 - DNA, 14 bp, Artificial sequence
  synthetic sequence
tccccactgggtac

SEQ ID NO: 1168 - DNA, 14 bp, Artificial sequence
  synthetic sequence
tgaatcactagaca

SEQ ID NO: 1169 - DNA, 14 bp, Artificial sequence
  synthetic sequence
aaacgtcgctctaa

SEQ ID NO: 1170 - DNA, 14 bp, Artificial sequence
  synthetic sequence
tagagagtcatcga

SEQ ID NO: 1171 - DNA, 14 bp, Artificial sequence
  synthetic sequence
agtggtcgtgccaa

SEQ ID NO: 1172 - DNA, 14 bp, Artificial sequence
  synthetic sequence
ataccgggtgtggg

SEQ ID NO: 1173 - DNA, 14 bp, Artificial sequence
  synthetic sequence
ccagtagcccatgt

SEQ ID NO: 1174 - DNA, 14 bp, Artificial sequence
  synthetic sequence
gtcccggaaattga

SEQ ID NO: 1175 - DNA, 14 bp, Artificial sequence
  synthetic sequence
aagtggaggctgta

SEQ ID NO: 1176 - DNA, 14 bp, Artificial sequence
  synthetic sequence
gtagagtagatagc

SEQ ID NO: 1177 - DNA, 14 bp, Artificial sequence
  synthetic sequence
gtcagctgcgccct

SEQ ID NO: 1178 - DNA, 14 bp, Artificial sequence
  synthetic sequence
acgttctaacgcag

SEQ ID NO: 1179 - DNA, 14 bp, Artificial sequence
  synthetic sequence
cggaccccactttc

SEQ ID NO: 1180 - DNA, 14 bp, Artificial sequence
  synthetic sequence
ggcttgagatgaag

SEQ ID NO: 1181 - DNA, 14 bp, Artificial sequence
  synthetic sequence
cgttactacgaccc

SEQ ID NO: 1182 - DNA, 14 bp, Artificial sequence
  synthetic sequence
tgcgtggcaggact

SEQ ID NO: 1183 - DNA, 14 bp, Artificial sequence
  synthetic sequence
tcatggctcagcaa

SEQ ID NO: 1184 - DNA, 14 bp, Artificial sequence
  synthetic sequence
gccgtcaacctcat

SEQ ID NO: 1185 - DNA, 14 bp, Artificial sequence
  synthetic sequence
tctccgtaaggcag

SEQ ID NO: 1186 - DNA, 14 bp, Artificial sequence
  synthetic sequence
ccgtgccgcaactt

SEQ ID NO: 1187 - DNA, 14 bp, Artificial sequence
  synthetic sequence
gttacatgcacgga

SEQ ID NO: 1188 - DNA, 14 bp, Artificial sequence
  synthetic sequence
gacgagtagatgat

SEQ ID NO: 1189 - DNA, 14 bp, Artificial sequence
  synthetic sequence
taggtaaagccgat

SEQ ID NO: 1190 - DNA, 14 bp, Artificial sequence
  synthetic sequence
aatatggctacggg

SEQ ID NO: 1191 - DNA, 14 bp, Artificial sequence
  synthetic sequence
gtggcgtcggtcga

SEQ ID NO: 1192 - DNA, 14 bp, Artificial sequence
  synthetic sequence
gcatgactcaggct

SEQ ID NO: 1193 - DNA, 14 bp, Artificial sequence
  synthetic sequence
cgtgaccagacttc

SEQ ID NO: 1194 - DNA, 14 bp, Artificial sequence
  synthetic sequence
aactactcaaactg

SEQ ID NO: 1195 - DNA, 14 bp, Artificial sequence
  synthetic sequence
tagggacgatgagt

SEQ ID NO: 1196 - DNA, 14 bp, Artificial sequence
  synthetic sequence
tggataatagcaaa

SEQ ID NO: 1197 - DNA, 14 bp, Artificial sequence
  synthetic sequence
tggatctcaagaag

SEQ ID NO: 1198 - DNA, 14 bp, Artificial sequence
  synthetic sequence
gggtatcagtaggg

SEQ ID NO: 1199 - DNA, 14 bp, Artificial sequence
  synthetic sequence
tcacctcgcatgaa

SEQ ID NO: 1200 - DNA, 14 bp, Artificial sequence
  synthetic sequence
catgggacgggtat

SEQ ID NO: 1201 - DNA, 14 bp, Artificial sequence
  synthetic sequence
agagttgagctccc

SEQ ID NO: 1202 - DNA, 14 bp, Artificial sequence
  synthetic sequence
caccaaattcagct

SEQ ID NO: 1203 - DNA, 14 bp, Artificial sequence
  synthetic sequence
tgatccccactccc

SEQ ID NO: 1204 - DNA, 14 bp, Artificial sequence
  synthetic sequence
atatccatcagagg

SEQ ID NO: 1205 - DNA, 14 bp, Artificial sequence
  synthetic sequence
caatccagtcctca

SEQ ID NO: 1206 - DNA, 14 bp, Artificial sequence
  synthetic sequence
agtgtacgccggtg

SEQ ID NO: 1207 - DNA, 14 bp, Artificial sequence
  synthetic sequence
tggacctgccctaa

SEQ ID NO: 1208 - DNA, 14 bp, Artificial sequence
  synthetic sequence
caaaattagatcgc

SEQ ID NO: 1209 - DNA, 14 bp, Artificial sequence
  synthetic sequence
ggtatggggatgag

SEQ ID NO: 1210 - DNA, 14 bp, Artificial sequence
  synthetic sequence
gatacgagatatac

SEQ ID NO: 1211 - DNA, 14 bp, Artificial sequence
  synthetic sequence
cagcacagtacttg

SEQ ID NO: 1212 - DNA, 14 bp, Artificial sequence
  synthetic sequence
atcccctgaatccc

SEQ ID NO: 1213 - DNA, 14 bp, Artificial sequence
  synthetic sequence
cattgaggactgcc

SEQ ID NO: 1214 - DNA, 14 bp, Artificial sequence
  synthetic sequence
gcggtgctacctgg

SEQ ID NO: 1215 - DNA, 14 bp, Artificial sequence
  synthetic sequence
catagtcctcaaag

SEQ ID NO: 1216 - DNA, 14 bp, Artificial sequence
  synthetic sequence
cctgcatgcgcgtg

SEQ ID NO: 1217 - DNA, 14 bp, Artificial sequence
  synthetic sequence
ccggtgcaaccatt

SEQ ID NO: 1218 - DNA, 14 bp, Artificial sequence
  synthetic sequence
cggaagttgatcag

SEQ ID NO: 1219 - DNA, 14 bp, Artificial sequence
  synthetic sequence
gaatctactaaccc

SEQ ID NO: 1220 - DNA, 14 bp, Artificial sequence
  synthetic sequence
gactcccactatac

SEQ ID NO: 1221 - DNA, 14 bp, Artificial sequence
  synthetic sequence
ggtctcaaatcgac

SEQ ID NO: 1222 - DNA, 14 bp, Artificial sequence
  synthetic sequence
ttgggactagggca

SEQ ID NO: 1223 - DNA, 14 bp, Artificial sequence
  synthetic sequence
tcctgcgctaccac

SEQ ID NO: 1224 - DNA, 14 bp, Artificial sequence
  synthetic sequence
tcacgtccgccata

SEQ ID NO: 1225 - DNA, 14 bp, Artificial sequence
  synthetic sequence
gcccagacgttggt

SEQ ID NO: 1226 - DNA, 14 bp, Artificial sequence
  synthetic sequence
tcacgttcccaacc

SEQ ID NO: 1227 - DNA, 14 bp, Artificial sequence
  synthetic sequence
cagtggaagcgtct

SEQ ID NO: 1228 - DNA, 14 bp, Artificial sequence
  synthetic sequence
aacactgtggggtg

SEQ ID NO: 1229 - DNA, 14 bp, Artificial sequence
  synthetic sequence
actatgtggggacc

SEQ ID NO: 1230 - DNA, 14 bp, Artificial sequence
  synthetic sequence
tatgtcaaccggcg

SEQ ID NO: 1231 - DNA, 14 bp, Artificial sequence
  synthetic sequence
gcctgtacaaaact

SEQ ID NO: 1232 - DNA, 14 bp, Artificial sequence
  synthetic sequence
cttccagatgcaac

SEQ ID NO: 1233 - DNA, 14 bp, Artificial sequence
  synthetic sequence
cccaagattaaact

SEQ ID NO: 1234 - DNA, 14 bp, Artificial sequence
  synthetic sequence
cttagtaacaagcg

SEQ ID NO: 1235 - DNA, 14 bp, Artificial sequence
  synthetic sequence
cacttcaaccctcc

SEQ ID NO: 1236 - DNA, 14 bp, Artificial sequence
  synthetic sequence
aattaccgtggcaa

SEQ ID NO: 1237 - DNA, 14 bp, Artificial sequence
  synthetic sequence
agctacataaatgg

SEQ ID NO: 1238 - DNA, 14 bp, Artificial sequence
  synthetic sequence
tcaggcgatgacta

SEQ ID NO: 1239 - DNA, 14 bp, Artificial sequence
  synthetic sequence
agtatgtcccgcag

SEQ ID NO: 1240 - DNA, 14 bp, Artificial sequence
  synthetic sequence
agaactctgggagt

SEQ ID NO: 1241 - DNA, 14 bp, Artificial sequence
  synthetic sequence
atcctgaccgtggg

SEQ ID NO: 1242 - DNA, 14 bp, Artificial sequence
  synthetic sequence
ctgacatgcatgag

SEQ ID NO: 1243 - DNA, 14 bp, Artificial sequence
  synthetic sequence
cagaaaagttccct

SEQ ID NO: 1244 - DNA, 14 bp, Artificial sequence
  synthetic sequence
cagtatcgatcgga

SEQ ID NO: 1245 - DNA, 14 bp, Artificial sequence
  synthetic sequence
ctccgacaactgct

SEQ ID NO: 1246 - DNA, 14 bp, Artificial sequence
  synthetic sequence
ccacgagattgagt

SEQ ID NO: 1247 - DNA, 14 bp, Artificial sequence
  synthetic sequence
tcgtcgccgacctg

SEQ ID NO: 1248 - DNA, 14 bp, Artificial sequence
  synthetic sequence
tcgggctcgtgggc

SEQ ID NO: 1249 - DNA, 14 bp, Artificial sequence
  synthetic sequence
aggacgggtaattg

SEQ ID NO: 1250 - DNA, 14 bp, Artificial sequence
  synthetic sequence
agtatgaagtagga

SEQ ID NO: 1251 - DNA, 14 bp, Artificial sequence
  synthetic sequence
tcttaagagacacc

SEQ ID NO: 1252 - DNA, 14 bp, Artificial sequence
  synthetic sequence
gcgcgacttgagct

SEQ ID NO: 1253 - DNA, 14 bp, Artificial sequence
  synthetic sequence
attgctccggagca

SEQ ID NO: 1254 - DNA, 14 bp, Artificial sequence
  synthetic sequence
gtcgtgcggagggt

SEQ ID NO: 1255 - DNA, 14 bp, Artificial sequence
  synthetic sequence
atggctaccgtcgg

SEQ ID NO: 1256 - DNA, 14 bp, Artificial sequence
  synthetic sequence
aggatcggtggatg

SEQ ID NO: 1257 - DNA, 14 bp, Artificial sequence
  synthetic sequence
caaactcggtcgtg

SEQ ID NO: 1258 - DNA, 14 bp, Artificial sequence
  synthetic sequence
ggcgctagcatcct

SEQ ID NO: 1259 - DNA, 14 bp, Artificial sequence
  synthetic sequence
agagaagaaatatt

SEQ ID NO: 1260 - DNA, 14 bp, Artificial sequence
  synthetic sequence
cgttgggacgtaga

SEQ ID NO: 1261 - DNA, 14 bp, Artificial sequence
  synthetic sequence
ggaacgtcccctta

SEQ ID NO: 1262 - DNA, 14 bp, Artificial sequence
  synthetic sequence
cggtgctggaggta

SEQ ID NO: 1263 - DNA, 14 bp, Artificial sequence
  synthetic sequence
gggtaacaggactt

SEQ ID NO: 1264 - DNA, 14 bp, Artificial sequence
  synthetic sequence
acctctctgcacgg

SEQ ID NO: 1265 - DNA, 14 bp, Artificial sequence
  synthetic sequence
cacggtaactcgtg

SEQ ID NO: 1266 - DNA, 14 bp, Artificial sequence
  synthetic sequence
gtctagcatggagg

SEQ ID NO: 1267 - DNA, 14 bp, Artificial sequence
  synthetic sequence
atcgtccgagcggt

SEQ ID NO: 1268 - DNA, 14 bp, Artificial sequence
  synthetic sequence
gtgcgaatactgcc

SEQ ID NO: 1269 - DNA, 14 bp, Artificial sequence
  synthetic sequence
catcctaggctcga

SEQ ID NO: 1270 - DNA, 14 bp, Artificial sequence
  synthetic sequence
ctgaacgaatctcg

SEQ ID NO: 1271 - DNA, 14 bp, Artificial sequence
  synthetic sequence
tatgtaagaaccaa

SEQ ID NO: 1272 - DNA, 14 bp, Artificial sequence
  synthetic sequence
ctgaaaagatctac

SEQ ID NO: 1273 - DNA, 14 bp, Artificial sequence
  synthetic sequence
agattaccccgtaa

SEQ ID NO: 1274 - DNA, 14 bp, Artificial sequence
  synthetic sequence
gatcgcgatatagc

SEQ ID NO: 1275 - DNA, 14 bp, Artificial sequence
  synthetic sequence
gccaccgagattgt

SEQ ID NO: 1276 - DNA, 14 bp, Artificial sequence
  synthetic sequence
ggtatcagatgaca

SEQ ID NO: 1277 - DNA, 14 bp, Artificial sequence
  synthetic sequence
cggtggcatcctga

SEQ ID NO: 1278 - DNA, 14 bp, Artificial sequence
  synthetic sequence
tactaacgagtgaa

SEQ ID NO: 1279 - DNA, 14 bp, Artificial sequence
  synthetic sequence
tccgctcccagtgg

SEQ ID NO: 1280 - DNA, 14 bp, Artificial sequence
  synthetic sequence
agatagagttgaga

SEQ ID NO: 1281 - DNA, 14 bp, Artificial sequence
  synthetic sequence
taatgcacggtgcg

SEQ ID NO: 1282 - DNA, 14 bp, Artificial sequence
  synthetic sequence
tcgttcaaacaacc

SEQ ID NO: 1283 - DNA, 14 bp, Artificial sequence
  synthetic sequence
taggaactaggatc

SEQ ID NO: 1284 - DNA, 14 bp, Artificial sequence
  synthetic sequence
ctcgttcgacagaa

SEQ ID NO: 1285 - DNA, 14 bp, Artificial sequence
  synthetic sequence
cgggactggatgat

SEQ ID NO: 1286 - DNA, 14 bp, Artificial sequence
  synthetic sequence
actgtgccatgccg

SEQ ID NO: 1287 - DNA, 14 bp, Artificial sequence
  synthetic sequence
gtttacgcgaaaag

SEQ ID NO: 1288 - DNA, 14 bp, Artificial sequence
  synthetic sequence
gcttcccacttgca

SEQ ID NO: 1289 - DNA, 14 bp, Artificial sequence
  synthetic sequence
gaacaagtctttcg

SEQ ID NO: 1290 - DNA, 14 bp, Artificial sequence
  synthetic sequence
atgcatcaatatgg

SEQ ID NO: 1291 - DNA, 14 bp, Artificial sequence
  synthetic sequence
agcattatgtacgc

SEQ ID NO: 1292 - DNA, 14 bp, Artificial sequence
  synthetic sequence
aatagatcacgttc

SEQ ID NO: 1293 - DNA, 14 bp, Artificial sequence
  synthetic sequence
cggataatcttccg

SEQ ID NO: 1294 - DNA, 14 bp, Artificial sequence
  synthetic sequence
aacattacgggtgt

SEQ ID NO: 1295 - DNA, 14 bp, Artificial sequence
  synthetic sequence
tcacatatgcatca

SEQ ID NO: 1296 - DNA, 14 bp, Artificial sequence
  synthetic sequence
agtctggccttggc

SEQ ID NO: 1297 - DNA, 14 bp, Artificial sequence
  synthetic sequence
attaaagtagcggt

SEQ ID NO: 1298 - DNA, 14 bp, Artificial sequence
  synthetic sequence
atcattccccatac

SEQ ID NO: 1299 - DNA, 14 bp, Artificial sequence
  synthetic sequence
tctcgcccatctag

SEQ ID NO: 1300 - DNA, 14 bp, Artificial sequence
  synthetic sequence
atcacgtgatcagt

SEQ ID NO: 1301 - DNA, 14 bp, Artificial sequence
  synthetic sequence
gataaacacattat

SEQ ID NO: 1302 - DNA, 14 bp, Artificial sequence
  synthetic sequence
atcaaactgcatta

SEQ ID NO: 1303 - DNA, 14 bp, Artificial sequence
  synthetic sequence
gaggtatcctccat

SEQ ID NO: 1304 - DNA, 14 bp, Artificial sequence
  synthetic sequence
agaatttgcgagct

SEQ ID NO: 1305 - DNA, 14 bp, Artificial sequence
  synthetic sequence
gctaagttccgtcc

SEQ ID NO: 1306 - DNA, 14 bp, Artificial sequence
  synthetic sequence
agcggttcaatctg

SEQ ID NO: 1307 - DNA, 14 bp, Artificial sequence
  synthetic sequence
gattgggatgctac

SEQ ID NO: 1308 - DNA, 14 bp, Artificial sequence
  synthetic sequence
gagtactatgtcca

SEQ ID NO: 1309 - DNA, 14 bp, Artificial sequence
  synthetic sequence
gttaccaaccttca

SEQ ID NO: 1310 - DNA, 14 bp, Artificial sequence
  synthetic sequence
tccacctttcagag

SEQ ID NO: 1311 - DNA, 14 bp, Artificial sequence
  synthetic sequence
tgaaactatctaaa

SEQ ID NO: 1312 - DNA, 14 bp, Artificial sequence
  synthetic sequence
ggaatatactatac

SEQ ID NO: 1313 - DNA, 14 bp, Artificial sequence
  synthetic sequence
tatgggtaatgaga

SEQ ID NO: 1314 - DNA, 14 bp, Artificial sequence
  synthetic sequence
cttgctggacaggt

SEQ ID NO: 1315 - DNA, 14 bp, Artificial sequence
  synthetic sequence
ttcatcgtcaggac

SEQ ID NO: 1316 - DNA, 14 bp, Artificial sequence
  synthetic sequence
gtgtgaatgtccaa

SEQ ID NO: 1317 - DNA, 14 bp, Artificial sequence
  synthetic sequence
gtaaacctagttga

SEQ ID NO: 1318 - DNA, 14 bp, Artificial sequence
  synthetic sequence
gtgtcgtacgagtg

SEQ ID NO: 1319 - DNA, 14 bp, Artificial sequence
  synthetic sequence
gcttaagtccgctc

SEQ ID NO: 1320 - DNA, 14 bp, Artificial sequence
  synthetic sequence
gtcttggcgtcggc

SEQ ID NO: 1321 - DNA, 14 bp, Artificial sequence
  synthetic sequence
aaatgcgctcttag

SEQ ID NO: 1322 - DNA, 14 bp, Artificial sequence
  synthetic sequence
cggtcgactggtta

SEQ ID NO: 1323 - DNA, 14 bp, Artificial sequence
  synthetic sequence
tagggctaaattgg

SEQ ID NO: 1324 - DNA, 14 bp, Artificial sequence
  synthetic sequence
ttgacgggctgggt

SEQ ID NO: 1325 - DNA, 14 bp, Artificial sequence
  synthetic sequence
ctaaagcactttcc

SEQ ID NO: 1326 - DNA, 14 bp, Artificial sequence
  synthetic sequence
acaagttcaaaatt

SEQ ID NO: 1327 - DNA, 14 bp, Artificial sequence
  synthetic sequence
tcatagattgcccc

SEQ ID NO: 1328 - DNA, 14 bp, Artificial sequence
  synthetic sequence
cgtccggcatgtct

SEQ ID NO: 1329 - DNA, 14 bp, Artificial sequence
  synthetic sequence
ttctaaaagcatcg

SEQ ID NO: 1330 - DNA, 14 bp, Artificial sequence
  synthetic sequence
cgtgcagattggtc

SEQ ID NO: 1331 - DNA, 14 bp, Artificial sequence
  synthetic sequence
aattcgttaccaaa

SEQ ID NO: 1332 - DNA, 14 bp, Artificial sequence
  synthetic sequence
taaacggtggcatt

SEQ ID NO: 1333 - DNA, 14 bp, Artificial sequence
  synthetic sequence
aacagtgaataatt

SEQ ID NO: 1334 - DNA, 14 bp, Artificial sequence
  synthetic sequence
ctatacgttacggc

SEQ ID NO: 1335 - DNA, 14 bp, Artificial sequence
  synthetic sequence
tcacggtctgcagt

SEQ ID NO: 1336 - DNA, 14 bp, Artificial sequence
  synthetic sequence
atcgcctcacatta

SEQ ID NO: 1337 - DNA, 14 bp, Artificial sequence
  synthetic sequence
taaaaatgatgggt

SEQ ID NO: 1338 - DNA, 14 bp, Artificial sequence
  synthetic sequence
gatgtaactacgat

SEQ ID NO: 1339 - DNA, 14 bp, Artificial sequence
  synthetic sequence
tagagattgtaaag

SEQ ID NO: 1340 - DNA, 14 bp, Artificial sequence
  synthetic sequence
tgcgactgtatcac

SEQ ID NO: 1341 - DNA, 14 bp, Artificial sequence
  synthetic sequence
gacccacttataat

SEQ ID NO: 1342 - DNA, 14 bp, Artificial sequence
  synthetic sequence
tcgaagcatagatt

SEQ ID NO: 1343 - DNA, 14 bp, Artificial sequence
  synthetic sequence
gtaaaggttccggt

SEQ ID NO: 1344 - DNA, 14 bp, Artificial sequence
  synthetic sequence
ggcgtcattcgcct

SEQ ID NO: 1345 - DNA, 14 bp, Artificial sequence
  synthetic sequence
tcaatagcctagtc

SEQ ID NO: 1346 - DNA, 14 bp, Artificial sequence
  synthetic sequence
catttatccaacgc

SEQ ID NO: 1347 - DNA, 14 bp, Artificial sequence
  synthetic sequence
cccattcggatcgt

SEQ ID NO: 1348 - DNA, 14 bp, Artificial sequence
  synthetic sequence
gcatcttaacgtac

SEQ ID NO: 1349 - DNA, 14 bp, Artificial sequence
  synthetic sequence
ggctttcccccgta

SEQ ID NO: 1350 - DNA, 14 bp, Artificial sequence
  synthetic sequence
ccgtggtctatggg

SEQ ID NO: 1351 - DNA, 14 bp, Artificial sequence
  synthetic sequence
aatttactcgcgga

SEQ ID NO: 1352 - DNA, 14 bp, Artificial sequence
  synthetic sequence
tacctcggtggcct

SEQ ID NO: 1353 - DNA, 14 bp, Artificial sequence
  synthetic sequence
tcccccacacttta

SEQ ID NO: 1354 - DNA, 14 bp, Artificial sequence
  synthetic sequence
cccttgcgtgtacc

SEQ ID NO: 1355 - DNA, 14 bp, Artificial sequence
  synthetic sequence
attaacgtctcaca

SEQ ID NO: 1356 - DNA, 14 bp, Artificial sequence
  synthetic sequence
gcctttcgtacgac

SEQ ID NO: 1357 - DNA, 14 bp, Artificial sequence
  synthetic sequence
gcatattgtaccga

SEQ ID NO: 1358 - DNA, 14 bp, Artificial sequence
  synthetic sequence
tgatttagcacgga

SEQ ID NO: 1359 - DNA, 14 bp, Artificial sequence
  synthetic sequence
aggttagtacacta

SEQ ID NO: 1360 - DNA, 14 bp, Artificial sequence
  synthetic sequence
tgcgctccctgcta

SEQ ID NO: 1361 - DNA, 14 bp, Artificial sequence
  synthetic sequence
tacaagttcaaagt

SEQ ID NO: 1362 - DNA, 14 bp, Artificial sequence
  synthetic sequence
atggctggcccttg

SEQ ID NO: 1363 - DNA, 14 bp, Artificial sequence
  synthetic sequence
cgcctaagatgtta

SEQ ID NO: 1364 - DNA, 14 bp, Artificial sequence
  synthetic sequence
gtgcccactccctt

SEQ ID NO: 1365 - DNA, 14 bp, Artificial sequence
  synthetic sequence
gaagtgttagcgta

SEQ ID NO: 1366 - DNA, 14 bp, Artificial sequence
  synthetic sequence
tagcgtccttgagc

SEQ ID NO: 1367 - DNA, 14 bp, Artificial sequence
  synthetic sequence
acgctctcggttga

SEQ ID NO: 1368 - DNA, 14 bp, Artificial sequence
  synthetic sequence
gcgttcttgggagg

SEQ ID NO: 1369 - DNA, 14 bp, Artificial sequence
  synthetic sequence
atctgtcaaagagt

SEQ ID NO: 1370 - DNA, 14 bp, Artificial sequence
  synthetic sequence
ctatccagaaatgt

SEQ ID NO: 1371 - DNA, 14 bp, Artificial sequence
  synthetic sequence
caatgaccagtttg

SEQ ID NO: 1372 - DNA, 14 bp, Artificial sequence
  synthetic sequence
agcatgtcggaatt

SEQ ID NO: 1373 - DNA, 14 bp, Artificial sequence
  synthetic sequence
aagtggatagcttc

SEQ ID NO: 1374 - DNA, 14 bp, Artificial sequence
  synthetic sequence
ttcagcttgagagg

SEQ ID NO: 1375 - DNA, 14 bp, Artificial sequence
  synthetic sequence
gaattctgagatgg

SEQ ID NO: 1376 - DNA, 14 bp, Artificial sequence
  synthetic sequence
agtaggtcaactat

SEQ ID NO: 1377 - DNA, 14 bp, Artificial sequence
  synthetic sequence
cgcttgctgagcat

SEQ ID NO: 1378 - DNA, 14 bp, Artificial sequence
  synthetic sequence
accttattgcagaa

SEQ ID NO: 1379 - DNA, 14 bp, Artificial sequence
  synthetic sequence
gtgggcaatagtat

SEQ ID NO: 1380 - DNA, 14 bp, Artificial sequence
  synthetic sequence
tactactacatccc

SEQ ID NO: 1381 - DNA, 14 bp, Artificial sequence
  synthetic sequence
tggttcgagcacat

SEQ ID NO: 1382 - DNA, 14 bp, Artificial sequence
  synthetic sequence
ggtcttcaatgacg

SEQ ID NO: 1383 - DNA, 14 bp, Artificial sequence
  synthetic sequence
attcagacatcgct

SEQ ID NO: 1384 - DNA, 14 bp, Artificial sequence
  synthetic sequence
ggggctcaaccttt

SEQ ID NO: 1385 - DNA, 14 bp, Artificial sequence
  synthetic sequence
aacgactttaaact

SEQ ID NO: 1386 - DNA, 14 bp, Artificial sequence
  synthetic sequence
atgatagtctaagc

SEQ ID NO: 1387 - DNA, 14 bp, Artificial sequence
  synthetic sequence
gtaccaccgcttta

SEQ ID NO: 1388 - DNA, 14 bp, Artificial sequence
  synthetic sequence
ggaactttcggtaa

SEQ ID NO: 1389 - DNA, 14 bp, Artificial sequence
  synthetic sequence
ggcaagtgtatctg

SEQ ID NO: 1390 - DNA, 14 bp, Artificial sequence
  synthetic sequence
gttcgcatgatacg

SEQ ID NO: 1391 - DNA, 14 bp, Artificial sequence
  synthetic sequence
aggaccctctattg

SEQ ID NO: 1392 - DNA, 14 bp, Artificial sequence
  synthetic sequence
agttatccgtaccg

SEQ ID NO: 1393 - DNA, 14 bp, Artificial sequence
  synthetic sequence
gcactcgcggtatt

SEQ ID NO: 1394 - DNA, 14 bp, Artificial sequence
  synthetic sequence
ctgcccgatgttag

SEQ ID NO: 1395 - DNA, 14 bp, Artificial sequence
  synthetic sequence
atactgatccgcct

SEQ ID NO: 1396 - DNA, 14 bp, Artificial sequence
  synthetic sequence
agatttgtaggaac

SEQ ID NO: 1397 - DNA, 14 bp, Artificial sequence
  synthetic sequence
gagtcgctgtatgc

SEQ ID NO: 1398 - DNA, 14 bp, Artificial sequence
  synthetic sequence
cggttatcgagatc

SEQ ID NO: 1399 - DNA, 14 bp, Artificial sequence
  synthetic sequence
tcgagcggctgtat

SEQ ID NO: 1400 - DNA, 14 bp, Artificial sequence
  synthetic sequence
acgctgttaaacat

SEQ ID NO: 1401 - DNA, 14 bp, Artificial sequence
  synthetic sequence
ccgtttacgatgcg

SEQ ID NO: 1402 - DNA, 14 bp, Artificial sequence
  synthetic sequence
cttgtgacctccgc

SEQ ID NO: 1403 - DNA, 14 bp, Artificial sequence
  synthetic sequence
aaagtattgacatc

SEQ ID NO: 1404 - DNA, 14 bp, Artificial sequence
  synthetic sequence
gtgatgaggtgcgt

SEQ ID NO: 1405 - DNA, 14 bp, Artificial sequence
  synthetic sequence
tatagcgtacggct

SEQ ID NO: 1406 - DNA, 14 bp, Artificial sequence
  synthetic sequence
cctctaatatcgcc

SEQ ID NO: 1407 - DNA, 14 bp, Artificial sequence
  synthetic sequence
gtttggtccgacca

SEQ ID NO: 1408 - DNA, 14 bp, Artificial sequence
  synthetic sequence
cttagcaatcaggt

SEQ ID NO: 1409 - DNA, 14 bp, Artificial sequence
  synthetic sequence
tatcaggctcatac

SEQ ID NO: 1410 - DNA, 14 bp, Artificial sequence
  synthetic sequence
ctgaacctaggctt

SEQ ID NO: 1411 - DNA, 14 bp, Artificial sequence
  synthetic sequence
acgttgagtgctga

SEQ ID NO: 1412 - DNA, 14 bp, Artificial sequence
  synthetic sequence
cagttcaactggtc

SEQ ID NO: 1413 - DNA, 14 bp, Artificial sequence
  synthetic sequence
gtctatactcccgc

SEQ ID NO: 1414 - DNA, 14 bp, Artificial sequence
  synthetic sequence
ccgattggcctgtg

SEQ ID NO: 1415 - DNA, 14 bp, Artificial sequence
  synthetic sequence
attcggtaccccct

SEQ ID NO: 1416 - DNA, 14 bp, Artificial sequence
  synthetic sequence
tcatatcatgaggc

SEQ ID NO: 1417 - DNA, 14 bp, Artificial sequence
  synthetic sequence
catgtgttcgcccg

SEQ ID NO: 1418 - DNA, 14 bp, Artificial sequence
  synthetic sequence
cgattatcccggct

SEQ ID NO: 1419 - DNA, 14 bp, Artificial sequence
  synthetic sequence
gccatatataactg

SEQ ID NO: 1420 - DNA, 14 bp, Artificial sequence
  synthetic sequence
aattgatagtagga

SEQ ID NO: 1421 - DNA, 14 bp, Artificial sequence
  synthetic sequence
agttcagtggatgg

SEQ ID NO: 1422 - DNA, 14 bp, Artificial sequence
  synthetic sequence
caatgggtgagtgt

SEQ ID NO: 1423 - DNA, 14 bp, Artificial sequence
  synthetic sequence
gatctaatgcgtac

SEQ ID NO: 1424 - DNA, 14 bp, Artificial sequence
  synthetic sequence
tagcaggcgtctgt

SEQ ID NO: 1425 - DNA, 14 bp, Artificial sequence
  synthetic sequence
tagacttctaaggg

SEQ ID NO: 1426 - DNA, 14 bp, Artificial sequence
  synthetic sequence
ttcggctcctgaag

SEQ ID NO: 1427 - DNA, 14 bp, Artificial sequence
  synthetic sequence
ggagcgtgactatt

SEQ ID NO: 1428 - DNA, 14 bp, Artificial sequence
  synthetic sequence
aggtatcggatctc

SEQ ID NO: 1429 - DNA, 14 bp, Artificial sequence
  synthetic sequence
aaacctactaatta

SEQ ID NO: 1430 - DNA, 14 bp, Artificial sequence
  synthetic sequence
gcaagctgatttgc

SEQ ID NO: 1431 - DNA, 14 bp, Artificial sequence
  synthetic sequence
ataacgtgcgttcc

SEQ ID NO: 1432 - DNA, 14 bp, Artificial sequence
  synthetic sequence
tctaatcaccgata

SEQ ID NO: 1433 - DNA, 14 bp, Artificial sequence
  synthetic sequence
gttaagacctgatg

SEQ ID NO: 1434 - DNA, 14 bp, Artificial sequence
  synthetic sequence
agtgtccaatagtg

SEQ ID NO: 1435 - DNA, 14 bp, Artificial sequence
  synthetic sequence
ataagtgaaactat

SEQ ID NO: 1436 - DNA, 14 bp, Artificial sequence
  synthetic sequence
atagcccctgtcgt

SEQ ID NO: 1437 - DNA, 14 bp, Artificial sequence
  synthetic sequence
tgctgagcgtgtac

SEQ ID NO: 1438 - DNA, 14 bp, Artificial sequence
  synthetic sequence
tacgctcgacctgt

SEQ ID NO: 1439 - DNA, 14 bp, Artificial sequence
  synthetic sequence
gatcagtgtgtcaa

SEQ ID NO: 1440 - DNA, 14 bp, Artificial sequence
  synthetic sequence
tcataatccagtgg

SEQ ID NO: 1441 - DNA, 14 bp, Artificial sequence
  synthetic sequence
agataaaccatttc

SEQ ID NO: 1442 - DNA, 14 bp, Artificial sequence
  synthetic sequence
tcgtctacccctgg

SEQ ID NO: 1443 - DNA, 14 bp, Artificial sequence
  synthetic sequence
ggacgatggtggtt

SEQ ID NO: 1444 - DNA, 14 bp, Artificial sequence
  synthetic sequence
gccctgtgacctgt

SEQ ID NO: 1445 - DNA, 14 bp, Artificial sequence
  synthetic sequence
aagcgtaaattggt

SEQ ID NO: 1446 - DNA, 14 bp, Artificial sequence
  synthetic sequence
aataggtggtagat

SEQ ID NO: 1447 - DNA, 14 bp, Artificial sequence
  synthetic sequence
gtttacgatggaca

SEQ ID NO: 1448 - DNA, 14 bp, Artificial sequence
  synthetic sequence
aacatataatggtg

SEQ ID NO: 1449 - DNA, 14 bp, Artificial sequence
  synthetic sequence
agtaatggctagtc

SEQ ID NO: 1450 - DNA, 14 bp, Artificial sequence
  synthetic sequence
gttgagcaagttcc

SEQ ID NO: 1451 - DNA, 14 bp, Artificial sequence
  synthetic sequence
acaactactgctct

SEQ ID NO: 1452 - DNA, 14 bp, Artificial sequence
  synthetic sequence
gtgatagagttgga

SEQ ID NO: 1453 - DNA, 14 bp, Artificial sequence
  synthetic sequence
ctctatcagggtca

SEQ ID NO: 1454 - DNA, 14 bp, Artificial sequence
  synthetic sequence
cacatcatgtgctg

SEQ ID NO: 1455 - DNA, 14 bp, Artificial sequence
  synthetic sequence
agagtcgttgctcg

SEQ ID NO: 1456 - DNA, 14 bp, Artificial sequence
  synthetic sequence
cccgagtctgtctc

SEQ ID NO: 1457 - DNA, 14 bp, Artificial sequence
  synthetic sequence
catagagatgttgc

SEQ ID NO: 1458 - DNA, 14 bp, Artificial sequence
  synthetic sequence
gagagtcatacctt

SEQ ID NO: 1459 - DNA, 14 bp, Artificial sequence
  synthetic sequence
cggtcttcgggcct

SEQ ID NO: 1460 - DNA, 14 bp, Artificial sequence
  synthetic sequence
ccgttcctggcgct

SEQ ID NO: 1461 - DNA, 14 bp, Artificial sequence
  synthetic sequence
acgtttcgaccgat

SEQ ID NO: 1462 - DNA, 14 bp, Artificial sequence
  synthetic sequence
gtgcttgatcacaa

SEQ ID NO: 1463 - DNA, 14 bp, Artificial sequence
  synthetic sequence
tcaccaaagtactt

SEQ ID NO: 1464 - DNA, 14 bp, Artificial sequence
  synthetic sequence
cgttaatatagcgg

SEQ ID NO: 1465 - DNA, 14 bp, Artificial sequence
  synthetic sequence
tatgcagctaaatc

SEQ ID NO: 1466 - DNA, 14 bp, Artificial sequence
  synthetic sequence
gtgcttgctcgacg

SEQ ID NO: 1467 - DNA, 14 bp, Artificial sequence
  synthetic sequence
ccccgttgttgacg

SEQ ID NO: 1468 - DNA, 14 bp, Artificial sequence
  synthetic sequence
cctgcgaaaatctt

SEQ ID NO: 1469 - DNA, 14 bp, Artificial sequence
  synthetic sequence
tgtcacacgggtat

SEQ ID NO: 1470 - DNA, 14 bp, Artificial sequence
  synthetic sequence
aaatctgctgtgcc

SEQ ID NO: 1471 - DNA, 14 bp, Artificial sequence
  synthetic sequence
aggtctcttcgaag

SEQ ID NO: 1472 - DNA, 14 bp, Artificial sequence
  synthetic sequence
cgaccgttcctagt

SEQ ID NO: 1473 - DNA, 14 bp, Artificial sequence
  synthetic sequence
tccgcgtctcctca

SEQ ID NO: 1474 - DNA, 14 bp, Artificial sequence
  synthetic sequence
agtagtagttacgg

SEQ ID NO: 1475 - DNA, 14 bp, Artificial sequence
  synthetic sequence
gtgatgcaggctat

SEQ ID NO: 1476 - DNA, 14 bp, Artificial sequence
  synthetic sequence
tcagctacaagttc

SEQ ID NO: 1477 - DNA, 14 bp, Artificial sequence
  synthetic sequence
tccctcacctactc

SEQ ID NO: 1478 - DNA, 14 bp, Artificial sequence
  synthetic sequence
actcttagtggcag

SEQ ID NO: 1479 - DNA, 14 bp, Artificial sequence
  synthetic sequence
gaagtgatcttacc

SEQ ID NO: 1480 - DNA, 14 bp, Artificial sequence
  synthetic sequence
acggttatatagca

SEQ ID NO: 1481 - DNA, 14 bp, Artificial sequence
  synthetic sequence
gggtgattaactaa

SEQ ID NO: 1482 - DNA, 14 bp, Artificial sequence
  synthetic sequence
ttaagatgtaggag

SEQ ID NO: 1483 - DNA, 14 bp, Artificial sequence
  synthetic sequence
actaagctctcatc

SEQ ID NO: 1484 - DNA, 14 bp, Artificial sequence
  synthetic sequence
ctggcttgaataaa

SEQ ID NO: 1485 - DNA, 14 bp, Artificial sequence
  synthetic sequence
aaaccgcttgtgat

SEQ ID NO: 1486 - DNA, 14 bp, Artificial sequence
  synthetic sequence
gtaacgtctaggtg

SEQ ID NO: 1487 - DNA, 14 bp, Artificial sequence
  synthetic sequence
actgtcgagcctct

SEQ ID NO: 1488 - DNA, 14 bp, Artificial sequence
  synthetic sequence
atttgggtgaagca

SEQ ID NO: 1489 - DNA, 14 bp, Artificial sequence
  synthetic sequence
tcgtctcgcaaata

SEQ ID NO: 1490 - DNA, 14 bp, Artificial sequence
  synthetic sequence
agctattataccgc

SEQ ID NO: 1491 - DNA, 14 bp, Artificial sequence
  synthetic sequence
ctgggtagatagct

SEQ ID NO: 1492 - DNA, 14 bp, Artificial sequence
  synthetic sequence
cctccacttatgcg

SEQ ID NO: 1493 - DNA, 14 bp, Artificial sequence
  synthetic sequence
actcctagggtatg

SEQ ID NO: 1494 - DNA, 14 bp, Artificial sequence
  synthetic sequence
cctttactgacggc

SEQ ID NO: 1495 - DNA, 14 bp, Artificial sequence
  synthetic sequence
actgtcgcataatc

SEQ ID NO: 1496 - DNA, 14 bp, Artificial sequence
  synthetic sequence
atctcagtctccag

SEQ ID NO: 1497 - DNA, 14 bp, Artificial sequence
  synthetic sequence
cgctggcctgctct

SEQ ID NO: 1498 - DNA, 14 bp, Artificial sequence
  synthetic sequence
aactttgggcctgg

SEQ ID NO: 1499 - DNA, 14 bp, Artificial sequence
  synthetic sequence
ctcgtaatacatgg

SEQ ID NO: 1500 - DNA, 14 bp, Artificial sequence
  synthetic sequence
aggactttgaatca

SEQ ID NO: 1501 - DNA, 14 bp, Artificial sequence
  synthetic sequence
atgttagacgtgaa

SEQ ID NO: 1502 - DNA, 14 bp, Artificial sequence
  synthetic sequence
aaagattttgcccc

SEQ ID NO: 1503 - DNA, 14 bp, Artificial sequence
  synthetic sequence
aaagtacgtataat

SEQ ID NO: 1504 - DNA, 14 bp, Artificial sequence
  synthetic sequence
tcgagttctaacca

SEQ ID NO: 1505 - DNA, 14 bp, Artificial sequence
  synthetic sequence
atgttaggtacccc

SEQ ID NO: 1506 - DNA, 14 bp, Artificial sequence
  synthetic sequence
actcgagcgtcctt

SEQ ID NO: 1507 - DNA, 14 bp, Artificial sequence
  synthetic sequence
atgctactactggg

SEQ ID NO: 1508 - DNA, 14 bp, Artificial sequence
  synthetic sequence
ttggtcgataagac

SEQ ID NO: 1509 - DNA, 14 bp, Artificial sequence
  synthetic sequence
cagttgtgccctgg

SEQ ID NO: 1510 - DNA, 14 bp, Artificial sequence
  synthetic sequence
agtacgatgtactg

SEQ ID NO: 1511 - DNA, 14 bp, Artificial sequence
  synthetic sequence
gcttcgtgaaagct

SEQ ID NO: 1512 - DNA, 14 bp, Artificial sequence
  synthetic sequence
tgccacgtcggttg

SEQ ID NO: 1513 - DNA, 14 bp, Artificial sequence
  synthetic sequence
ctacttgcgagatc

SEQ ID NO: 1514 - DNA, 14 bp, Artificial sequence
  synthetic sequence
taagatttgggagg

SEQ ID NO: 1515 - DNA, 14 bp, Artificial sequence
  synthetic sequence
tacccaggttcgta

SEQ ID NO: 1516 - DNA, 14 bp, Artificial sequence
  synthetic sequence
ttgggctccctcaa

SEQ ID NO: 1517 - DNA, 14 bp, Artificial sequence
  synthetic sequence
ataactcacgttag

SEQ ID NO: 1518 - DNA, 14 bp, Artificial sequence
  synthetic sequence
gcgttcagaccttg

SEQ ID NO: 1519 - DNA, 14 bp, Artificial sequence
  synthetic sequence
cgattaaactcgat

SEQ ID NO: 1520 - DNA, 14 bp, Artificial sequence
  synthetic sequence
ataattgacgtaca

SEQ ID NO: 1521 - DNA, 14 bp, Artificial sequence
  synthetic sequence
ctgatttacggaac

SEQ ID NO: 1522 - DNA, 14 bp, Artificial sequence
  synthetic sequence
gcactgttcgtacg

SEQ ID NO: 1523 - DNA, 14 bp, Artificial sequence
  synthetic sequence
ctctcatgacagtg

SEQ ID NO: 1524 - DNA, 14 bp, Artificial sequence
  synthetic sequence
tgcctggtgcactg

SEQ ID NO: 1525 - DNA, 14 bp, Artificial sequence
  synthetic sequence
tccttacgtgggga

SEQ ID NO: 1526 - DNA, 14 bp, Artificial sequence
  synthetic sequence
aaatgcgagtctta

SEQ ID NO: 1527 - DNA, 14 bp, Artificial sequence
  synthetic sequence
gggttcgagtaatg

SEQ ID NO: 1528 - DNA, 14 bp, Artificial sequence
  synthetic sequence
ctactactatcgag

SEQ ID NO: 1529 - DNA, 14 bp, Artificial sequence
  synthetic sequence
aacaaaggatttgt

SEQ ID NO: 1530 - DNA, 14 bp, Artificial sequence
  synthetic sequence
agtgtactacgcct

SEQ ID NO: 1531 - DNA, 14 bp, Artificial sequence
  synthetic sequence
atctacccaactgt

SEQ ID NO: 1532 - DNA, 14 bp, Artificial sequence
  synthetic sequence
tgggacgagcttgt

SEQ ID NO: 1533 - DNA, 14 bp, Artificial sequence
  synthetic sequence
gttggatgatacca

SEQ ID NO: 1534 - DNA, 14 bp, Artificial sequence
  synthetic sequence
agttgttaacggga

SEQ ID NO: 1535 - DNA, 14 bp, Artificial sequence
  synthetic sequence
tcattagctgccga

SEQ ID NO: 1536 - DNA, 14 bp, Artificial sequence
  synthetic sequence
gtttgtcaccaaag

SEQ ID NO: 1537 - DNA, 14 bp, Artificial sequence
  synthetic sequence
ctgttggcccactc

SEQ ID NO: 1538 - DNA, 14 bp, Artificial sequence
  synthetic sequence
taggtaagagatct

SEQ ID NO: 1539 - DNA, 14 bp, Artificial sequence
  synthetic sequence
gcgtgagaccttat

SEQ ID NO: 1540 - DNA, 14 bp, Artificial sequence
  synthetic sequence
caattaagcattcg

SEQ ID NO: 1541 - DNA, 14 bp, Artificial sequence
  synthetic sequence
cgcacgttagttca

SEQ ID NO: 1542 - DNA, 14 bp, Artificial sequence
  synthetic sequence
gagtcccacttctg

SEQ ID NO: 1543 - DNA, 14 bp, Artificial sequence
  synthetic sequence
tacaattagcatgg

SEQ ID NO: 1544 - DNA, 14 bp, Artificial sequence
  synthetic sequence
ctctctccctacag

SEQ ID NO: 1545 - DNA, 14 bp, Artificial sequence
  synthetic sequence
tttagaccgctcac

SEQ ID NO: 1546 - DNA, 14 bp, Artificial sequence
  synthetic sequence
cgacctaccattct

SEQ ID NO: 1547 - DNA, 14 bp, Artificial sequence
  synthetic sequence
ttgaaaacgataat

SEQ ID NO: 1548 - DNA, 14 bp, Artificial sequence
  synthetic sequence
tcgcgtacggcctt

SEQ ID NO: 1549 - DNA, 14 bp, Artificial sequence
  synthetic sequence
gtaccggaaggttt

SEQ ID NO: 1550 - DNA, 14 bp, Artificial sequence
  synthetic sequence
tcataaccgtggct

SEQ ID NO: 1551 - DNA, 14 bp, Artificial sequence
  synthetic sequence
aatagtcgacatat

SEQ ID NO: 1552 - DNA, 14 bp, Artificial sequence
  synthetic sequence
cgtatgccatgctc

SEQ ID NO: 1553 - DNA, 14 bp, Artificial sequence
  synthetic sequence
gtttgcgcgactgc

SEQ ID NO: 1554 - DNA, 14 bp, Artificial sequence
  synthetic sequence
aggaatttataccg

SEQ ID NO: 1555 - DNA, 14 bp, Artificial sequence
  synthetic sequence
cttggccgtaatga

SEQ ID NO: 1556 - DNA, 14 bp, Artificial sequence
  synthetic sequence
tcaacaatggggtt

SEQ ID NO: 1557 - DNA, 14 bp, Artificial sequence
  synthetic sequence
caccgagtacattt

SEQ ID NO: 1558 - DNA, 14 bp, Artificial sequence
  synthetic sequence
gcctgcacttataa

SEQ ID NO: 1559 - DNA, 14 bp, Artificial sequence
  synthetic sequence
ggtgccaggtcctt

SEQ ID NO: 1560 - DNA, 14 bp, Artificial sequence
  synthetic sequence
tcatcataggtaga

SEQ ID NO: 1561 - DNA, 14 bp, Artificial sequence
  synthetic sequence
aggaccctttcgct

SEQ ID NO: 1562 - DNA, 14 bp, Artificial sequence
  synthetic sequence
aggtacgactcttg

SEQ ID NO: 1563 - DNA, 14 bp, Artificial sequence
  synthetic sequence
ctgatatagaacta

SEQ ID NO: 1564 - DNA, 14 bp, Artificial sequence
  synthetic sequence
acttagggttagga

SEQ ID NO: 1565 - DNA, 14 bp, Artificial sequence
  synthetic sequence
ggtcatggtcggtc

SEQ ID NO: 1566 - DNA, 14 bp, Artificial sequence
  synthetic sequence
ctggtcgcttacgc

SEQ ID NO: 1567 - DNA, 14 bp, Artificial sequence
  synthetic sequence
tcgggcttgtccag

SEQ ID NO: 1568 - DNA, 14 bp, Artificial sequence
  synthetic sequence
caacggctttctcg

SEQ ID NO: 1569 - DNA, 14 bp, Artificial sequence
  synthetic sequence
cgtcattcgaggtg

SEQ ID NO: 1570 - DNA, 14 bp, Artificial sequence
  synthetic sequence
atctcaaaatagct

SEQ ID NO: 1571 - DNA, 14 bp, Artificial sequence
  synthetic sequence
tacttacgaggtcg

SEQ ID NO: 1572 - DNA, 14 bp, Artificial sequence
  synthetic sequence
agcacgaatttagt

SEQ ID NO: 1573 - DNA, 14 bp, Artificial sequence
  synthetic sequence
ccgtgacttgaata

SEQ ID NO: 1574 - DNA, 14 bp, Artificial sequence
  synthetic sequence
ggaatgatctgata

SEQ ID NO: 1575 - DNA, 14 bp, Artificial sequence
  synthetic sequence
taatcaacggttac

SEQ ID NO: 1576 - DNA, 14 bp, Artificial sequence
  synthetic sequence
agcttgtgctacga

SEQ ID NO: 1577 - DNA, 14 bp, Artificial sequence
  synthetic sequence
tataaactgcggat

SEQ ID NO: 1578 - DNA, 14 bp, Artificial sequence
  synthetic sequence
caggcccataattt

SEQ ID NO: 1579 - DNA, 14 bp, Artificial sequence
  synthetic sequence
gcattggagtgctc

SEQ ID NO: 1580 - DNA, 14 bp, Artificial sequence
  synthetic sequence
gactgctccttaca

SEQ ID NO: 1581 - DNA, 14 bp, Artificial sequence
  synthetic sequence
gctgtgctgggatc

SEQ ID NO: 1582 - DNA, 14 bp, Artificial sequence
  synthetic sequence
tcgtgaccgcttcg

SEQ ID NO: 1583 - DNA, 14 bp, Artificial sequence
  synthetic sequence
acgcttcattaaag

SEQ ID NO: 1584 - DNA, 14 bp, Artificial sequence
  synthetic sequence
aaaagctactattc

SEQ ID NO: 1585 - DNA, 14 bp, Artificial sequence
  synthetic sequence
tacagcgcatttcg

SEQ ID NO: 1586 - DNA, 14 bp, Artificial sequence
  synthetic sequence
taagttccataaag

SEQ ID NO: 1587 - DNA, 14 bp, Artificial sequence
  synthetic sequence
aattttggacgccg

SEQ ID NO: 1588 - DNA, 14 bp, Artificial sequence
  synthetic sequence
cctctctggatcga

SEQ ID NO: 1589 - DNA, 14 bp, Artificial sequence
  synthetic sequence
cccttcatacccct

SEQ ID NO: 1590 - DNA, 14 bp, Artificial sequence
  synthetic sequence
atgcttactgaccc

SEQ ID NO: 1591 - DNA, 14 bp, Artificial sequence
  synthetic sequence
gagtctagttgcac

SEQ ID NO: 1592 - DNA, 14 bp, Artificial sequence
  synthetic sequence
ggcactcttagcat

SEQ ID NO: 1593 - DNA, 14 bp, Artificial sequence
  synthetic sequence
aatcattcccaagt

SEQ ID NO: 1594 - DNA, 14 bp, Artificial sequence
  synthetic sequence
tgataggcaggttc

SEQ ID NO: 1595 - DNA, 14 bp, Artificial sequence
  synthetic sequence
atcggcttgctggg

SEQ ID NO: 1596 - DNA, 14 bp, Artificial sequence
  synthetic sequence
gtctaagtgaaatc

SEQ ID NO: 1597 - DNA, 14 bp, Artificial sequence
  synthetic sequence
acggtgaaaatttg

SEQ ID NO: 1598 - DNA, 14 bp, Artificial sequence
  synthetic sequence
atgccgcttctcaa

SEQ ID NO: 1599 - DNA, 14 bp, Artificial sequence
  synthetic sequence
aattcgtcgagggt

SEQ ID NO: 1600 - DNA, 14 bp, Artificial sequence
  synthetic sequence
ctctatcgggcatc

SEQ ID NO: 1601 - DNA, 14 bp, Artificial sequence
  synthetic sequence
agtctcgcgagctt

SEQ ID NO: 1602 - DNA, 14 bp, Artificial sequence
  synthetic sequence
cccgttggcagtat

SEQ ID NO: 1603 - DNA, 14 bp, Artificial sequence
  synthetic sequence
gaactctccaattg

SEQ ID NO: 1604 - DNA, 14 bp, Artificial sequence
  synthetic sequence
ggtgtcaattccgg

SEQ ID NO: 1605 - DNA, 14 bp, Artificial sequence
  synthetic sequence
taatcagggttgaa

SEQ ID NO: 1606 - DNA, 14 bp, Artificial sequence
  synthetic sequence
gtggcgtcgacatt

SEQ ID NO: 1607 - DNA, 14 bp, Artificial sequence
  synthetic sequence
attgatctcaacgc

SEQ ID NO: 1608 - DNA, 14 bp, Artificial sequence
  synthetic sequence
cgggagcatcgttt

SEQ ID NO: 1609 - DNA, 14 bp, Artificial sequence
  synthetic sequence
atatccggctcctc

SEQ ID NO: 1610 - DNA, 14 bp, Artificial sequence
  synthetic sequence
ctggaccctcactt

SEQ ID NO: 1611 - DNA, 14 bp, Artificial sequence
  synthetic sequence
gggtagtcaatgtc

SEQ ID NO: 1612 - DNA, 14 bp, Artificial sequence
  synthetic sequence
tccgttacccctaa

SEQ ID NO: 1613 - DNA, 14 bp, Artificial sequence
  synthetic sequence
gctagctcctccta

SEQ ID NO: 1614 - DNA, 14 bp, Artificial sequence
  synthetic sequence
ttaggtgaccgcta

SEQ ID NO: 1615 - DNA, 14 bp, Artificial sequence
  synthetic sequence
tgcgtgcgactcgt

SEQ ID NO: 1616 - DNA, 14 bp, Artificial sequence
  synthetic sequence
gagtccattatgcg

SEQ ID NO: 1617 - DNA, 14 bp, Artificial sequence
  synthetic sequence
ctgacgccctctgt

SEQ ID NO: 1618 - DNA, 14 bp, Artificial sequence
  synthetic sequence
cgtaatcagaatat

SEQ ID NO: 1619 - DNA, 14 bp, Artificial sequence
  synthetic sequence
atctagactctaaa

SEQ ID NO: 1620 - DNA, 14 bp, Artificial sequence
  synthetic sequence
tacgttaggatggg

SEQ ID NO: 1621 - DNA, 14 bp, Artificial sequence
  synthetic sequence
cagtattaccatca

SEQ ID NO: 1622 - DNA, 14 bp, Artificial sequence
  synthetic sequence
tcccttactccacg

SEQ ID NO: 1623 - DNA, 14 bp, Artificial sequence
  synthetic sequence
ttcatacgactccc

SEQ ID NO: 1624 - DNA, 14 bp, Artificial sequence
  synthetic sequence
cctggcgagttact

SEQ ID NO: 1625 - DNA, 14 bp, Artificial sequence
  synthetic sequence
aatgaactggtctg

SEQ ID NO: 1626 - DNA, 14 bp, Artificial sequence
  synthetic sequence
acttctccatacga

SEQ ID NO: 1627 - DNA, 14 bp, Artificial sequence
  synthetic sequence
ctacatgattgccg

SEQ ID NO: 1628 - DNA, 14 bp, Artificial sequence
  synthetic sequence
atggcttcggtaac

SEQ ID NO: 1629 - DNA, 14 bp, Artificial sequence
  synthetic sequence
caccccttgtatca

SEQ ID NO: 1630 - DNA, 14 bp, Artificial sequence
  synthetic sequence
tgcactaataaatg

SEQ ID NO: 1631 - DNA, 14 bp, Artificial sequence
  synthetic sequence
gtctgtcgtacccg

SEQ ID NO: 1632 - DNA, 14 bp, Artificial sequence
  synthetic sequence
actcgggttgtcct

SEQ ID NO: 1633 - DNA, 14 bp, Artificial sequence
  synthetic sequence
ggccgtcagttatt

SEQ ID NO: 1634 - DNA, 14 bp, Artificial sequence
  synthetic sequence
ggtcattattacgc

SEQ ID NO: 1635 - DNA, 14 bp, Artificial sequence
  synthetic sequence
acgtcggtatgctt

SEQ ID NO: 1636 - DNA, 14 bp, Artificial sequence
  synthetic sequence
gattgtacatagta

SEQ ID NO: 1637 - DNA, 14 bp, Artificial sequence
  synthetic sequence
tgctgtcggaatgt

SEQ ID NO: 1638 - DNA, 14 bp, Artificial sequence
  synthetic sequence
ccgggttctagttc

SEQ ID NO: 1639 - DNA, 14 bp, Artificial sequence
  synthetic sequence
atacgatttcatac

SEQ ID NO: 1640 - DNA, 14 bp, Artificial sequence
  synthetic sequence
tggctattcaagat

SEQ ID NO: 1641 - DNA, 14 bp, Artificial sequence
  synthetic sequence
ggacgtgtgtattc

SEQ ID NO: 1642 - DNA, 14 bp, Artificial sequence
  synthetic sequence
tatgcggtaagttc

SEQ ID NO: 1643 - DNA, 14 bp, Artificial sequence
  synthetic sequence
cacggcgtgtcttt

SEQ ID NO: 1644 - DNA, 14 bp, Artificial sequence
  synthetic sequence
atatattccaagta

SEQ ID NO: 1645 - DNA, 14 bp, Artificial sequence
  synthetic sequence
ttcttaatccccgc

SEQ ID NO: 1646 - DNA, 14 bp, Artificial sequence
  synthetic sequence
gcatggcttgttcg

SEQ ID NO: 1647 - DNA, 14 bp, Artificial sequence
  synthetic sequence
aggcacactttttc

SEQ ID NO: 1648 - DNA, 14 bp, Artificial sequence
  synthetic sequence
gctctaactgttgc

SEQ ID NO: 1649 - DNA, 14 bp, Artificial sequence
  synthetic sequence
gataggcccttctt

SEQ ID NO: 1650 - DNA, 14 bp, Artificial sequence
  synthetic sequence
tgatttggggatcg

SEQ ID NO: 1651 - DNA, 14 bp, Artificial sequence
  synthetic sequence
gattcaatagatta

SEQ ID NO: 1652 - DNA, 14 bp, Artificial sequence
  synthetic sequence
ttgcagcgactgtt

SEQ ID NO: 1653 - DNA, 14 bp, Artificial sequence
  synthetic sequence
tatgctggatatcg

SEQ ID NO: 1654 - DNA, 14 bp, Artificial sequence
  synthetic sequence
ctacataattagat

SEQ ID NO: 1655 - DNA, 14 bp, Artificial sequence
  synthetic sequence
gctgtctcatagct

SEQ ID NO: 1656 - DNA, 14 bp, Artificial sequence
  synthetic sequence
ccgacttacacttt

SEQ ID NO: 1657 - DNA, 14 bp, Artificial sequence
  synthetic sequence
tcactgatcagtta

SEQ ID NO: 1658 - DNA, 14 bp, Artificial sequence
  synthetic sequence
gtttgagcgttaca

SEQ ID NO: 1659 - DNA, 14 bp, Artificial sequence
  synthetic sequence
aacctatgggttgt

SEQ ID NO: 1660 - DNA, 14 bp, Artificial sequence
  synthetic sequence
agatggcattttaa

SEQ ID NO: 1661 - DNA, 14 bp, Artificial sequence
  synthetic sequence
tatcatgcatacat

SEQ ID NO: 1662 - DNA, 14 bp, Artificial sequence
  synthetic sequence
ttagatatacgtaa

SEQ ID NO: 1663 - DNA, 14 bp, Artificial sequence
  synthetic sequence
tgcaaggctgtttg

SEQ ID NO: 1664 - DNA, 14 bp, Artificial sequence
  synthetic sequence
agctggtgtttgcg

SEQ ID NO: 1665 - DNA, 14 bp, Artificial sequence
  synthetic sequence
actctatatcaatg

SEQ ID NO: 1666 - DNA, 14 bp, Artificial sequence
  synthetic sequence
aacttccctttccc

SEQ ID NO: 1667 - DNA, 14 bp, Artificial sequence
  synthetic sequence
gcgcacctttctta

SEQ ID NO: 1668 - DNA, 14 bp, Artificial sequence
  synthetic sequence
gttgacttgcctcg

SEQ ID NO: 1669 - DNA, 14 bp, Artificial sequence
  synthetic sequence
tgacttgctaatga

SEQ ID NO: 1670 - DNA, 14 bp, Artificial sequence
  synthetic sequence
gccattggattaat

SEQ ID NO: 1671 - DNA, 14 bp, Artificial sequence
  synthetic sequence
tttaccctgtggag

SEQ ID NO: 1672 - DNA, 14 bp, Artificial sequence
  synthetic sequence
tcatgtagtatacg

SEQ ID NO: 1673 - DNA, 14 bp, Artificial sequence
  synthetic sequence
acatactcactatt

SEQ ID NO: 1674 - DNA, 14 bp, Artificial sequence
  synthetic sequence
aatccgggttgtta

SEQ ID NO: 1675 - DNA, 14 bp, Artificial sequence
  synthetic sequence
tgtaaatgcaaatt

SEQ ID NO: 1676 - DNA, 14 bp, Artificial sequence
  synthetic sequence
tccgattacaattg

SEQ ID NO: 1677 - DNA, 14 bp, Artificial sequence
  synthetic sequence
tggccgttttcgag

SEQ ID NO: 1678 - DNA, 14 bp, Artificial sequence
  synthetic sequence
atcaacttctgggt

SEQ ID NO: 1679 - DNA, 14 bp, Artificial sequence
  synthetic sequence
tcagcggttgtcat

SEQ ID NO: 1680 - DNA, 14 bp, Artificial sequence
  synthetic sequence
tatttcatgcagac

SEQ ID NO: 1681 - DNA, 14 bp, Artificial sequence
  synthetic sequence
gccttttcccgaat

SEQ ID NO: 1682 - DNA, 14 bp, Artificial sequence
  synthetic sequence
tagttggctgatga

SEQ ID NO: 1683 - DNA, 14 bp, Artificial sequence
  synthetic sequence
cggtacgttctcct

SEQ ID NO: 1684 - DNA, 14 bp, Artificial sequence
  synthetic sequence
gggtttaacgatat

SEQ ID NO: 1685 - DNA, 14 bp, Artificial sequence
  synthetic sequence
taaattacatggat

SEQ ID NO: 1686 - DNA, 14 bp, Artificial sequence
  synthetic sequence
cgtttggatggcta

SEQ ID NO: 1687 - DNA, 14 bp, Artificial sequence
  synthetic sequence
aggatgtattatgg

SEQ ID NO: 1688 - DNA, 14 bp, Artificial sequence
  synthetic sequence
tgtatagcggagtt

SEQ ID NO: 1689 - DNA, 14 bp, Artificial sequence
  synthetic sequence
atcattgtccgact

SEQ ID NO: 1690 - DNA, 14 bp, Artificial sequence
  synthetic sequence
atctggtagttcag

SEQ ID NO: 1691 - DNA, 14 bp, Artificial sequence
  synthetic sequence
ggatagtacgtttg

SEQ ID NO: 1692 - DNA, 14 bp, Artificial sequence
  synthetic sequence
cttgctagctggta

SEQ ID NO: 1693 - DNA, 14 bp, Artificial sequence
  synthetic sequence
ggatgtctttggca

SEQ ID NO: 1694 - DNA, 14 bp, Artificial sequence
  synthetic sequence
gatataaaagtgtt

SEQ ID NO: 1695 - DNA, 14 bp, Artificial sequence
  synthetic sequence
ttgagacgttctca

SEQ ID NO: 1696 - DNA, 14 bp, Artificial sequence
  synthetic sequence
tagaagagtgttgt

SEQ ID NO: 1697 - DNA, 14 bp, Artificial sequence
  synthetic sequence
ttgttaacgtggcg

SEQ ID NO: 1698 - DNA, 14 bp, Artificial sequence
  synthetic sequence
ctgagtagtgtagt

SEQ ID NO: 1699 - DNA, 14 bp, Artificial sequence
  synthetic sequence
tcccgatagttcta

SEQ ID NO: 1700 - DNA, 14 bp, Artificial sequence
  synthetic sequence
attcgagtaagtgt

SEQ ID NO: 1701 - DNA, 14 bp, Artificial sequence
  synthetic sequence
atttaccataagtg

SEQ ID NO: 1702 - DNA, 14 bp, Artificial sequence
  synthetic sequence
ggctcagattctta

SEQ ID NO: 1703 - DNA, 14 bp, Artificial sequence
  synthetic sequence
ggtactggttagat

SEQ ID NO: 1704 - DNA, 14 bp, Artificial sequence
  synthetic sequence
acaggagttattct

SEQ ID NO: 1705 - DNA, 14 bp, Artificial sequence
  synthetic sequence
agtatacgattact

SEQ ID NO: 1706 - DNA, 14 bp, Artificial sequence
  synthetic sequence
tacttccaatcgtc

SEQ ID NO: 1707 - DNA, 14 bp, Artificial sequence
  synthetic sequence
cttatactgtcaaa

SEQ ID NO: 1708 - DNA, 14 bp, Artificial sequence
  synthetic sequence
gttaatgtcacctc

SEQ ID NO: 1709 - DNA, 14 bp, Artificial sequence
  synthetic sequence
tttcggtcaatccc

SEQ ID NO: 1710 - DNA, 14 bp, Artificial sequence
  synthetic sequence
gctccctttcgagt

SEQ ID NO: 1711 - DNA, 14 bp, Artificial sequence
  synthetic sequence
tagtactccccatt

SEQ ID NO: 1712 - DNA, 14 bp, Artificial sequence
  synthetic sequence
ctggttaacctagt

SEQ ID NO: 1713 - DNA, 14 bp, Artificial sequence
  synthetic sequence
agccttgcgctttg

SEQ ID NO: 1714 - DNA, 14 bp, Artificial sequence
  synthetic sequence
tccttagacattgg

SEQ ID NO: 1715 - DNA, 14 bp, Artificial sequence
  synthetic sequence
ttgctgtccggtaa

SEQ ID NO: 1716 - DNA, 14 bp, Artificial sequence
  synthetic sequence
ctatcagattatcg

SEQ ID NO: 1717 - DNA, 14 bp, Artificial sequence
  synthetic sequence
tggatcccggttat

SEQ ID NO: 1718 - DNA, 14 bp, Artificial sequence
  synthetic sequence
gtgtctacactatc

SEQ ID NO: 1719 - DNA, 14 bp, Artificial sequence
  synthetic sequence
atttagatacctgg

SEQ ID NO: 1720 - DNA, 14 bp, Artificial sequence
  synthetic sequence
taattcttcggagc

SEQ ID NO: 1721 - DNA, 14 bp, Artificial sequence
  synthetic sequence
atttctcgcgaaat

SEQ ID NO: 1722 - DNA, 14 bp, Artificial sequence
  synthetic sequence
tacagatggttcat

SEQ ID NO: 1723 - DNA, 14 bp, Artificial sequence
  synthetic sequence
tgaaacagtttagt

SEQ ID NO: 1724 - DNA, 14 bp, Artificial sequence
  synthetic sequence
ggcctttccatgat

SEQ ID NO: 1725 - DNA, 14 bp, Artificial sequence
  synthetic sequence
tgtatacaggtcta

SEQ ID NO: 1726 - DNA, 14 bp, Artificial sequence
  synthetic sequence
tcttctcgtccacg

SEQ ID NO: 1727 - DNA, 14 bp, Artificial sequence
  synthetic sequence
atttttcacaaccg

SEQ ID NO: 1728 - DNA, 14 bp, Artificial sequence
  synthetic sequence
gggtgatattgctc

SEQ ID NO: 1729 - DNA, 14 bp, Artificial sequence
  synthetic sequence
ttgcgaggttgact

SEQ ID NO: 1730 - DNA, 14 bp, Artificial sequence
  synthetic sequence
tgtagagttacagt

SEQ ID NO: 1731 - DNA, 14 bp, Artificial sequence
  synthetic sequence
ctttgagagcatct

SEQ ID NO: 1732 - DNA, 14 bp, Artificial sequence
  synthetic sequence
catatggtaatgtc

SEQ ID NO: 1733 - DNA, 14 bp, Artificial sequence
  synthetic sequence
atcgtttggaagct

SEQ ID NO: 1734 - DNA, 14 bp, Artificial sequence
  synthetic sequence
gggttatcattcga

SEQ ID NO: 1735 - DNA, 14 bp, Artificial sequence
  synthetic sequence
tgctatgggtccat

SEQ ID NO: 1736 - DNA, 14 bp, Artificial sequence
  synthetic sequence
tggggaaatcttat

SEQ ID NO: 1737 - DNA, 14 bp, Artificial sequence
  synthetic sequence
gttcaataggtaat

SEQ ID NO: 1738 - DNA, 14 bp, Artificial sequence
  synthetic sequence
ataaattctggact

SEQ ID NO: 1739 - DNA, 14 bp, Artificial sequence
  synthetic sequence
gattctgccctcct

SEQ ID NO: 1740 - DNA, 14 bp, Artificial sequence
  synthetic sequence
gtccaatctattaa

SEQ ID NO: 1741 - DNA, 14 bp, Artificial sequence
  synthetic sequence
attcagtttaccgc

SEQ ID NO: 1742 - DNA, 14 bp, Artificial sequence
  synthetic sequence
cgaaatctatgtta

SEQ ID NO: 1743 - DNA, 14 bp, Artificial sequence
  synthetic sequence
tcgtctgggagtct

SEQ ID NO: 1744 - DNA, 14 bp, Artificial sequence
  synthetic sequence
tcgaccttagcgtt

SEQ ID NO: 1745 - DNA, 14 bp, Artificial sequence
  synthetic sequence
caaagtatgtttca

SEQ ID NO: 1746 - DNA, 14 bp, Artificial sequence
  synthetic sequence
gttgaatccgtatg

SEQ ID NO: 1747 - DNA, 14 bp, Artificial sequence
  synthetic sequence
ggcgtatatccttg

SEQ ID NO: 1748 - DNA, 14 bp, Artificial sequence
  synthetic sequence
acctttgcctatca

SEQ ID NO: 1749 - DNA, 14 bp, Artificial sequence
  synthetic sequence
ttaatacgcgtctg

SEQ ID NO: 1750 - DNA, 14 bp, Artificial sequence
  synthetic sequence
taccgcctgtggtt

SEQ ID NO: 1751 - DNA, 14 bp, Artificial sequence
  synthetic sequence
tgtcattgaatagg

SEQ ID NO: 1752 - DNA, 14 bp, Artificial sequence
  synthetic sequence
tcgaacttgctact

SEQ ID NO: 1753 - DNA, 14 bp, Artificial sequence
  synthetic sequence
agtatgcttatacg

SEQ ID NO: 1754 - DNA, 14 bp, Artificial sequence
  synthetic sequence
taccatctcgtcta

SEQ ID NO: 1755 - DNA, 14 bp, Artificial sequence
  synthetic sequence
acattgttagtgag

SEQ ID NO: 1756 - DNA, 14 bp, Artificial sequence
  synthetic sequence
ctcgccgaattatt

SEQ ID NO: 1757 - DNA, 14 bp, Artificial sequence
  synthetic sequence
ggtttacatgatcg

SEQ ID NO: 1758 - DNA, 14 bp, Artificial sequence
  synthetic sequence
ttaaggagctcctt

SEQ ID NO: 1759 - DNA, 14 bp, Artificial sequence
  synthetic sequence
taatgccgttgcct

SEQ ID NO: 1760 - DNA, 14 bp, Artificial sequence
  synthetic sequence
aatctgatgagtct

SEQ ID NO: 1761 - DNA, 14 bp, Artificial sequence
  synthetic sequence
cattttctaagaca

SEQ ID NO: 1762 - DNA, 14 bp, Artificial sequence
  synthetic sequence
acctgcgcaatttt

SEQ ID NO: 1763 - DNA, 14 bp, Artificial sequence
  synthetic sequence
cccgctagttttag

SEQ ID NO: 1764 - DNA, 14 bp, Artificial sequence
  synthetic sequence
gtactgcacttatc

SEQ ID NO: 1765 - DNA, 14 bp, Artificial sequence
  synthetic sequence
tccgagttcttgcg

SEQ ID NO: 1766 - DNA, 14 bp, Artificial sequence
  synthetic sequence
tgcgtagtacgttc

SEQ ID NO: 1767 - DNA, 14 bp, Artificial sequence
  synthetic sequence
cattgtcggatatg

SEQ ID NO: 1768 - DNA, 14 bp, Artificial sequence
  synthetic sequence
ggcttcctgaattc

SEQ ID NO: 1769 - DNA, 14 bp, Artificial sequence
  synthetic sequence
acacgtttgtcact

SEQ ID NO: 1770 - DNA, 14 bp, Artificial sequence
  synthetic sequence
gtgctactccgtct

SEQ ID NO: 1771 - DNA, 14 bp, Artificial sequence
  synthetic sequence
aaattttggggata

SEQ ID NO: 1772 - DNA, 14 bp, Artificial sequence
  synthetic sequence
tatactaaggatat

SEQ ID NO: 1773 - DNA, 14 bp, Artificial sequence
  synthetic sequence
atccgtgtatgata

SEQ ID NO: 1774 - DNA, 14 bp, Artificial sequence
  synthetic sequence
ctcaaattatcact

SEQ ID NO: 1775 - DNA, 14 bp, Artificial sequence
  synthetic sequence
aatgttgcatctga

SEQ ID NO: 1776 - DNA, 14 bp, Artificial sequence
  synthetic sequence
agaaagttttacta

SEQ ID NO: 1777 - DNA, 14 bp, Artificial sequence
  synthetic sequence
gcttttgaaggaat

SEQ ID NO: 1778 - DNA, 14 bp, Artificial sequence
  synthetic sequence
gctttcagctacta

SEQ ID NO: 1779 - DNA, 14 bp, Artificial sequence
  synthetic sequence
gctttactctacac

SEQ ID NO: 1780 - DNA, 14 bp, Artificial sequence
  synthetic sequence
ttaagctacatagt

SEQ ID NO: 1781 - DNA, 14 bp, Artificial sequence
  synthetic sequence
gatttggcggtgct

SEQ ID NO: 1782 - DNA, 14 bp, Artificial sequence
  synthetic sequence
aagttgcctggatt

SEQ ID NO: 1783 - DNA, 14 bp, Artificial sequence
  synthetic sequence
cacattatttgaca

SEQ ID NO: 1784 - DNA, 14 bp, Artificial sequence
  synthetic sequence
tgtacccgtctata

SEQ ID NO: 1785 - DNA, 14 bp, Artificial sequence
  synthetic sequence
ttgtcacgtaacat

SEQ ID NO: 1786 - DNA, 14 bp, Artificial sequence
  synthetic sequence
gagatgaattgttc

SEQ ID NO: 1787 - DNA, 14 bp, Artificial sequence
  synthetic sequence
gattccttgtaaaa

SEQ ID NO: 1788 - DNA, 14 bp, Artificial sequence
  synthetic sequence
tcagactgttgatc

SEQ ID NO: 1789 - DNA, 14 bp, Artificial sequence
  synthetic sequence
gcgttcatttagac

SEQ ID NO: 1790 - DNA, 14 bp, Artificial sequence
  synthetic sequence
atattcatcgcata

SEQ ID NO: 1791 - DNA, 14 bp, Artificial sequence
  synthetic sequence
ctctgactttacga

SEQ ID NO: 1792 - DNA, 14 bp, Artificial sequence
  synthetic sequence
gctagtatgacctt

SEQ ID NO: 1793 - DNA, 14 bp, Artificial sequence
  synthetic sequence
tagtgcacttactc

SEQ ID NO: 1794 - DNA, 14 bp, Artificial sequence
  synthetic sequence
ctttaccatctgcc

SEQ ID NO: 1795 - DNA, 14 bp, Artificial sequence
  synthetic sequence
tgtcgctaatgaat

SEQ ID NO: 1796 - DNA, 14 bp, Artificial sequence
  synthetic sequence
gagctgagttttga

SEQ ID NO: 1797 - DNA, 14 bp, Artificial sequence
  synthetic sequence
ttagcattcatagg

SEQ ID NO: 1798 - DNA, 14 bp, Artificial sequence
  synthetic sequence
aatggtcctttacg

SEQ ID NO: 1799 - DNA, 14 bp, Artificial sequence
  synthetic sequence
tatgtaatgaactc

SEQ ID NO: 1800 - DNA, 14 bp, Artificial sequence
  synthetic sequence
gtgggtagtcattg

SEQ ID NO: 1801 - DNA, 14 bp, Artificial sequence
  synthetic sequence
cgtatgtcgtccgt

SEQ ID NO: 1802 - DNA, 14 bp, Artificial sequence
  synthetic sequence
gtactggtgtgcat

SEQ ID NO: 1803 - DNA, 14 bp, Artificial sequence
  synthetic sequence
tgacccttgtagtg

SEQ ID NO: 1804 - DNA, 14 bp, Artificial sequence
  synthetic sequence
gattctcacgttgg

SEQ ID NO: 1805 - DNA, 14 bp, Artificial sequence
  synthetic sequence
agctttgttagcaa

SEQ ID NO: 1806 - DNA, 14 bp, Artificial sequence
  synthetic sequence
gcctactatatatg

SEQ ID NO: 1807 - DNA, 14 bp, Artificial sequence
  synthetic sequence
aattttggcatcga

SEQ ID NO: 1808 - DNA, 14 bp, Artificial sequence
  synthetic sequence
acattggttactac

SEQ ID NO: 1809 - DNA, 14 bp, Artificial sequence
  synthetic sequence
aacaatgctgttct

SEQ ID NO: 1810 - DNA, 14 bp, Artificial sequence
  synthetic sequence
tgggttagaatgta

SEQ ID NO: 1811 - DNA, 14 bp, Artificial sequence
  synthetic sequence
tgcccgatgttatc

SEQ ID NO: 1812 - DNA, 14 bp, Artificial sequence
  synthetic sequence
attcatagggttac

SEQ ID NO: 1813 - DNA, 14 bp, Artificial sequence
  synthetic sequence
cttcatcttgacga

SEQ ID NO: 1814 - DNA, 14 bp, Artificial sequence
  synthetic sequence
actatatggaggtt

SEQ ID NO: 1815 - DNA, 14 bp, Artificial sequence
  synthetic sequence
ataggtaatgttca

SEQ ID NO: 1816 - DNA, 14 bp, Artificial sequence
  synthetic sequence
ctacgtgggtatgt

SEQ ID NO: 1817 - DNA, 14 bp, Artificial sequence
  synthetic sequence
cttcggtcactata

SEQ ID NO: 1818 - DNA, 14 bp, Artificial sequence
  synthetic sequence
tgtagccctttaag

SEQ ID NO: 1819 - DNA, 14 bp, Artificial sequence
  synthetic sequence
gaatttgcgcgttc

SEQ ID NO: 1820 - DNA, 14 bp, Artificial sequence
  synthetic sequence
aggtgtttagcaat

SEQ ID NO: 1821 - DNA, 14 bp, Artificial sequence
  synthetic sequence
cgttgctgattcac

SEQ ID NO: 1822 - DNA, 14 bp, Artificial sequence
  synthetic sequence
catctttatgcgcg

SEQ ID NO: 1823 - DNA, 14 bp, Artificial sequence
  synthetic sequence
taaattggtgtgcg

SEQ ID NO: 1824 - DNA, 14 bp, Artificial sequence
  synthetic sequence
ctcctgaactattc

SEQ ID NO: 1825 - DNA, 14 bp, Artificial sequence
  synthetic sequence
aatcgactctcttc

SEQ ID NO: 1826 - DNA, 14 bp, Artificial sequence
  synthetic sequence
ttcaatttgcaacc

SEQ ID NO: 1827 - DNA, 14 bp, Artificial sequence
  synthetic sequence
atattagctctgcg

SEQ ID NO: 1828 - DNA, 14 bp, Artificial sequence
  synthetic sequence
gacttaaggttcta

SEQ ID NO: 1829 - DNA, 14 bp, Artificial sequence
  synthetic sequence
cctctttacataaa

SEQ ID NO: 1830 - DNA, 14 bp, Artificial sequence
  synthetic sequence
gtaacacatttatg

SEQ ID NO: 1831 - DNA, 14 bp, Artificial sequence
  synthetic sequence
tgattaatgatccg

SEQ ID NO: 1832 - DNA, 14 bp, Artificial sequence
  synthetic sequence
ctctactggtggtg

SEQ ID NO: 1833 - DNA, 14 bp, Artificial sequence
  synthetic sequence
attttgtgcgggcg

SEQ ID NO: 1834 - DNA, 14 bp, Artificial sequence
  synthetic sequence
ccggagatttcgtt

SEQ ID NO: 1835 - DNA, 14 bp, Artificial sequence
  synthetic sequence
ctcttttgacaagc

SEQ ID NO: 1836 - DNA, 14 bp, Artificial sequence
  synthetic sequence
taattggatgacat

SEQ ID NO: 1837 - DNA, 14 bp, Artificial sequence
  synthetic sequence
agtttccacgttca

SEQ ID NO: 1838 - DNA, 14 bp, Artificial sequence
  synthetic sequence
cgtgttgtgtcaga

SEQ ID NO: 1839 - DNA, 14 bp, Artificial sequence
  synthetic sequence
agtagttttgggaa

SEQ ID NO: 1840 - DNA, 14 bp, Artificial sequence
  synthetic sequence
ttatgagggtcgtg

SEQ ID NO: 1841 - DNA, 14 bp, Artificial sequence
  synthetic sequence
tgcgagatctttgc

SEQ ID NO: 1842 - DNA, 14 bp, Artificial sequence
  synthetic sequence
taacctttcgatcg

SEQ ID NO: 1843 - DNA, 14 bp, Artificial sequence
  synthetic sequence
actctgagattata

SEQ ID NO: 1844 - DNA, 14 bp, Artificial sequence
  synthetic sequence
ttcgcctccggctt

SEQ ID NO: 1845 - DNA, 14 bp, Artificial sequence
  synthetic sequence
ccggtgttacattc

SEQ ID NO: 1846 - DNA, 14 bp, Artificial sequence
  synthetic sequence
tcggatcattcgat

SEQ ID NO: 1847 - DNA, 14 bp, Artificial sequence
  synthetic sequence
gattcatctatggc

SEQ ID NO: 1848 - DNA, 14 bp, Artificial sequence
  synthetic sequence
atttcctcgccata

SEQ ID NO: 1849 - DNA, 14 bp, Artificial sequence
  synthetic sequence
acgtctacgttaat

SEQ ID NO: 1850 - DNA, 14 bp, Artificial sequence
  synthetic sequence
agtaaggttatctc

SEQ ID NO: 1851 - DNA, 14 bp, Artificial sequence
  synthetic sequence
ccttctataatgcc

SEQ ID NO: 1852 - DNA, 14 bp, Artificial sequence
  synthetic sequence
gctcccgaatcttt

SEQ ID NO: 1853 - DNA, 14 bp, Artificial sequence
  synthetic sequence
ttgtttccaaaacc

SEQ ID NO: 1854 - DNA, 14 bp, Artificial sequence
  synthetic sequence
ttgaattgcacggt

SEQ ID NO: 1855 - DNA, 14 bp, Artificial sequence
  synthetic sequence
gtcttggttcagag

SEQ ID NO: 1856 - DNA, 14 bp, Artificial sequence
  synthetic sequence
taacgtggcttgtc

SEQ ID NO: 1857 - DNA, 14 bp, Artificial sequence
  synthetic sequence
tccttgtctgcgcc

SEQ ID NO: 1858 - DNA, 14 bp, Artificial sequence
  synthetic sequence
attgctgtatggga

SEQ ID NO: 1859 - DNA, 14 bp, Artificial sequence
  synthetic sequence
ttggattcaactaa

SEQ ID NO: 1860 - DNA, 14 bp, Artificial sequence
  synthetic sequence
cctttcatactggg

SEQ ID NO: 1861 - DNA, 14 bp, Artificial sequence
  synthetic sequence
cgaggctctatgtt

SEQ ID NO: 1862 - DNA, 14 bp, Artificial sequence
  synthetic sequence
gtctactttgaacg

SEQ ID NO: 1863 - DNA, 14 bp, Artificial sequence
  synthetic sequence
gcaaatatgtgttc

SEQ ID NO: 1864 - DNA, 14 bp, Artificial sequence
  synthetic sequence
gagtctaatttaga

SEQ ID NO: 1865 - DNA, 14 bp, Artificial sequence
  synthetic sequence
tcggtttgacataa

SEQ ID NO: 1866 - DNA, 14 bp, Artificial sequence
  synthetic sequence
cgtcttgctggtag

SEQ ID NO: 1867 - DNA, 14 bp, Artificial sequence
  synthetic sequence
ttgattatagcccg

SEQ ID NO: 1868 - DNA, 14 bp, Artificial sequence
  synthetic sequence
taatctcacgattc

SEQ ID NO: 1869 - DNA, 14 bp, Artificial sequence
  synthetic sequence
ctctgtccgtgtgg

SEQ ID NO: 1870 - DNA, 14 bp, Artificial sequence
  synthetic sequence
actccattcgattc

SEQ ID NO: 1871 - DNA, 14 bp, Artificial sequence
  synthetic sequence
ttgcacgtgattga

SEQ ID NO: 1872 - DNA, 14 bp, Artificial sequence
  synthetic sequence
cttcactatcgaat

SEQ ID NO: 1873 - DNA, 14 bp, Artificial sequence
  synthetic sequence
ggctacatagttct

SEQ ID NO: 1874 - DNA, 14 bp, Artificial sequence
  synthetic sequence
ggttttgtggcacc

SEQ ID NO: 1875 - DNA, 14 bp, Artificial sequence
  synthetic sequence
ttgtgtataagagc

SEQ ID NO: 1876 - DNA, 14 bp, Artificial sequence
  synthetic sequence
cgtgctagattgat

SEQ ID NO: 1877 - DNA, 14 bp, Artificial sequence
  synthetic sequence
ctcgattcctgtcg

SEQ ID NO: 1878 - DNA, 14 bp, Artificial sequence
  synthetic sequence
ttatcaaccgtcct

SEQ ID NO: 1879 - DNA, 14 bp, Artificial sequence
  synthetic sequence
ctcctgtgctagat

SEQ ID NO: 1880 - DNA, 14 bp, Artificial sequence
  synthetic sequence
cttgcgtattaaaa

SEQ ID NO: 1881 - DNA, 14 bp, Artificial sequence
  synthetic sequence
ctgtcacttgtaag

SEQ ID NO: 1882 - DNA, 14 bp, Artificial sequence
  synthetic sequence
catgcgtatgatgt

SEQ ID NO: 1883 - DNA, 14 bp, Artificial sequence
  synthetic sequence
ttcagcgcttctga

SEQ ID NO: 1884 - DNA, 14 bp, Artificial sequence
  synthetic sequence
tttcaccgggtata

SEQ ID NO: 1885 - DNA, 14 bp, Artificial sequence
  synthetic sequence
tcaacctggtttcg

SEQ ID NO: 1886 - DNA, 14 bp, Artificial sequence
  synthetic sequence
tggggctcctaatt

SEQ ID NO: 1887 - DNA, 14 bp, Artificial sequence
  synthetic sequence
atctatgtgagaat

SEQ ID NO: 1888 - DNA, 14 bp, Artificial sequence
  synthetic sequence
gatgtttctcgcgc

SEQ ID NO: 1889 - DNA, 14 bp, Artificial sequence
  synthetic sequence
acacctttgtgtgc

SEQ ID NO: 1890 - DNA, 14 bp, Artificial sequence
  synthetic sequence
gctggctttgtgtg

SEQ ID NO: 1891 - DNA, 14 bp, Artificial sequence
  synthetic sequence
ttaatcttaggtac

SEQ ID NO: 1892 - DNA, 14 bp, Artificial sequence
  synthetic sequence
ttgaagtctttagg

SEQ ID NO: 1893 - DNA, 14 bp, Artificial sequence
  synthetic sequence
gtgatcggaatttt

SEQ ID NO: 1894 - DNA, 14 bp, Artificial sequence
  synthetic sequence
tagcatgttttgca

SEQ ID NO: 1895 - DNA, 14 bp, Artificial sequence
  synthetic sequence
tttctgtgggccgt

SEQ ID NO: 1896 - DNA, 14 bp, Artificial sequence
  synthetic sequence
tcccgctctgtgtt

SEQ ID NO: 1897 - DNA, 14 bp, Artificial sequence
  synthetic sequence
agcctttcgtatat

SEQ ID NO: 1898 - DNA, 14 bp, Artificial sequence
  synthetic sequence
acaattccttgctt

SEQ ID NO: 1899 - DNA, 14 bp, Artificial sequence
  synthetic sequence
tgtggcatttgtgg

SEQ ID NO: 1900 - DNA, 14 bp, Artificial sequence
  synthetic sequence
taatgttctgatgc

SEQ ID NO: 1901 - DNA, 14 bp, Artificial sequence
  synthetic sequence
tccgtccttgtaat

SEQ ID NO: 1902 - DNA, 14 bp, Artificial sequence
  synthetic sequence
catttgtgagttgc

SEQ ID NO: 1903 - DNA, 14 bp, Artificial sequence
  synthetic sequence
tatgtgtccgtctc

SEQ ID NO: 1904 - DNA, 14 bp, Artificial sequence
  synthetic sequence
agtgacatggtttt

SEQ ID NO: 1905 - DNA, 14 bp, Artificial sequence
  synthetic sequence
ctgggtctcttgta

SEQ ID NO: 1906 - DNA, 14 bp, Artificial sequence
  synthetic sequence
ttgtagaatgattc

SEQ ID NO: 1907 - DNA, 14 bp, Artificial sequence
  synthetic sequence
tattatatggacta

SEQ ID NO: 1908 - DNA, 14 bp, Artificial sequence
  synthetic sequence
cggtggtatctatt

SEQ ID NO: 1909 - DNA, 14 bp, Artificial sequence
  synthetic sequence
ctttttgactaacc

SEQ ID NO: 1910 - DNA, 14 bp, Artificial sequence
  synthetic sequence
attacgctggtgtt

SEQ ID NO: 1911 - DNA, 14 bp, Artificial sequence
  synthetic sequence
tatttctaagagtg

SEQ ID NO: 1912 - DNA, 14 bp, Artificial sequence
  synthetic sequence
ttagtcctgtcact

SEQ ID NO: 1913 - DNA, 14 bp, Artificial sequence
  synthetic sequence
actgatttaagtat

SEQ ID NO: 1914 - DNA, 14 bp, Artificial sequence
  synthetic sequence
cagcttttggctta

SEQ ID NO: 1915 - DNA, 14 bp, Artificial sequence
  synthetic sequence
ggcgttctttcact

SEQ ID NO: 1916 - DNA, 14 bp, Artificial sequence
  synthetic sequence
ggtatgttcgtgtc

SEQ ID NO: 1917 - DNA, 14 bp, Artificial sequence
  synthetic sequence
attctgttacgtaa

SEQ ID NO: 1918 - DNA, 14 bp, Artificial sequence
  synthetic sequence
catgatcaatttct

SEQ ID NO: 1919 - DNA, 14 bp, Artificial sequence
  synthetic sequence
ctatgttagttaac

SEQ ID NO: 1920 - DNA, 14 bp, Artificial sequence
  synthetic sequence
tccttgtcgtagat

SEQ ID NO: 1921 - DNA, 14 bp, Artificial sequence
  synthetic sequence
attgtcgtgatagt

SEQ ID NO: 1922 - DNA, 14 bp, Artificial sequence
  synthetic sequence
tgatattagcactt

SEQ ID NO: 1923 - DNA, 14 bp, Artificial sequence
  synthetic sequence
tcgtggattgatat

SEQ ID NO: 1924 - DNA, 14 bp, Artificial sequence
  synthetic sequence
tacttgttgatacg

SEQ ID NO: 1925 - DNA, 14 bp, Artificial sequence
  synthetic sequence
ttgattgtggataa

SEQ ID NO: 1926 - DNA, 14 bp, Artificial sequence
  synthetic sequence
agggtgtatttaat

SEQ ID NO: 1927 - DNA, 14 bp, Artificial sequence
  synthetic sequence
cgtcgtgttactat

SEQ ID NO: 1928 - DNA, 14 bp, Artificial sequence
  synthetic sequence
taatatcttagcgt

SEQ ID NO: 1929 - DNA, 14 bp, Artificial sequence
  synthetic sequence
ggagatcttttggt

SEQ ID NO: 1930 - DNA, 14 bp, Artificial sequence
  synthetic sequence
atatccttcatgct

SEQ ID NO: 1931 - DNA, 14 bp, Artificial sequence
  synthetic sequence
cttagatcttagtg

SEQ ID NO: 1932 - DNA, 14 bp, Artificial sequence
  synthetic sequence
ttattgtaccactg

SEQ ID NO: 1933 - DNA, 14 bp, Artificial sequence
  synthetic sequence
gcagtgccttcttt

SEQ ID NO: 1934 - DNA, 14 bp, Artificial sequence
  synthetic sequence
attatcatgtctac

SEQ ID NO: 1935 - DNA, 14 bp, Artificial sequence
  synthetic sequence
cacctgtatttcat

SEQ ID NO: 1936 - DNA, 14 bp, Artificial sequence
  synthetic sequence
ctatgttgaagttc

SEQ ID NO: 1937 - DNA, 14 bp, Artificial sequence
  synthetic sequence
ctgctgtgcttata

SEQ ID NO: 1938 - DNA, 14 bp, Artificial sequence
  synthetic sequence
tttctgacaccttg

SEQ ID NO: 1939 - DNA, 14 bp, Artificial sequence
  synthetic sequence
tagcggcatttttg

SEQ ID NO: 1940 - DNA, 14 bp, Artificial sequence
  synthetic sequence
catcggtcttcttc

SEQ ID NO: 1941 - DNA, 14 bp, Artificial sequence
  synthetic sequence
gttactaatgtgtg

SEQ ID NO: 1942 - DNA, 14 bp, Artificial sequence
  synthetic sequence
gattgatctagtct

SEQ ID NO: 1943 - DNA, 14 bp, Artificial sequence
  synthetic sequence
gtagttatgattcg

SEQ ID NO: 1944 - DNA, 14 bp, Artificial sequence
  synthetic sequence
ttttcaagtggata

SEQ ID NO: 1945 - DNA, 14 bp, Artificial sequence
  synthetic sequence
tctatttcatcagc

SEQ ID NO: 1946 - DNA, 14 bp, Artificial sequence
  synthetic sequence
gggcttcgttctgt

SEQ ID NO: 1947 - DNA, 14 bp, Artificial sequence
  synthetic sequence
tttgtccttaccgc

SEQ ID NO: 1948 - DNA, 14 bp, Artificial sequence
  synthetic sequence
catgtctctttagc

SEQ ID NO: 1949 - DNA, 14 bp, Artificial sequence
  synthetic sequence
tgtgtagtgcctgt

SEQ ID NO: 1950 - DNA, 14 bp, Artificial sequence
  synthetic sequence
tacatatatgtggt

SEQ ID NO: 1951 - DNA, 14 bp, Artificial sequence
  synthetic sequence
ggttctgtctgggt

SEQ ID NO: 1952 - DNA, 14 bp, Artificial sequence
  synthetic sequence
ggagcttattgtta

SEQ ID NO: 1953 - DNA, 14 bp, Artificial sequence
  synthetic sequence
tgtgcttatagact

SEQ ID NO: 1954 - DNA, 14 bp, Artificial sequence
  synthetic sequence
gctattcttggtga

SEQ ID NO: 1955 - DNA, 14 bp, Artificial sequence
  synthetic sequence
gattatcgtgcctt

SEQ ID NO: 1956 - DNA, 14 bp, Artificial sequence
  synthetic sequence
attactttctagcg

SEQ ID NO: 1957 - DNA, 14 bp, Artificial sequence
  synthetic sequence
atttcgtggagttg

SEQ ID NO: 1958 - DNA, 14 bp, Artificial sequence
  synthetic sequence
ttcttgggcctact

SEQ ID NO: 1959 - DNA, 14 bp, Artificial sequence
  synthetic sequence
ctttgatcttcagc

SEQ ID NO: 1960 - DNA, 14 bp, Artificial sequence
  synthetic sequence
agcgattcttagtt

SEQ ID NO: 1961 - DNA, 14 bp, Artificial sequence
  synthetic sequence
cattctcattgtga

SEQ ID NO: 1962 - DNA, 14 bp, Artificial sequence
  synthetic sequence
ctttcttctgaaga

SEQ ID NO: 1963 - DNA, 14 bp, Artificial sequence
  synthetic sequence
ggctttctagtgtg

SEQ ID NO: 1964 - DNA, 14 bp, Artificial sequence
  synthetic sequence
tatggaaactcttt

SEQ ID NO: 1965 - DNA, 14 bp, Artificial sequence
  synthetic sequence
tgttagatgtggta

SEQ ID NO: 1966 - DNA, 14 bp, Artificial sequence
  synthetic sequence
ttgcattggtcctc

SEQ ID NO: 1967 - DNA, 14 bp, Artificial sequence
  synthetic sequence
gcgcgttttatcat

SEQ ID NO: 1968 - DNA, 14 bp, Artificial sequence
  synthetic sequence
ctagattgtctgtc

SEQ ID NO: 1969 - DNA, 14 bp, Artificial sequence
  synthetic sequence
ctaaagatcctttt

SEQ ID NO: 1970 - DNA, 14 bp, Artificial sequence
  synthetic sequence
tcgttcttgagctc

SEQ ID NO: 1971 - DNA, 14 bp, Artificial sequence
  synthetic sequence
ttattcaagttgca

SEQ ID NO: 1972 - DNA, 14 bp, Artificial sequence
  synthetic sequence
gccgtttacgtttc

SEQ ID NO: 1973 - DNA, 14 bp, Artificial sequence
  synthetic sequence
tcgtttactctcga

SEQ ID NO: 1974 - DNA, 14 bp, Artificial sequence
  synthetic sequence
atcgtttccttgga

SEQ ID NO: 1975 - DNA, 14 bp, Artificial sequence
  synthetic sequence
tattgcatctcact

SEQ ID NO: 1976 - DNA, 14 bp, Artificial sequence
  synthetic sequence
ttgtgagtcatgct

SEQ ID NO: 1977 - DNA, 14 bp, Artificial sequence
  synthetic sequence
tgttgatgccttga

SEQ ID NO: 1978 - DNA, 14 bp, Artificial sequence
  synthetic sequence
gtagttttagctcc

SEQ ID NO: 1979 - DNA, 14 bp, Artificial sequence
  synthetic sequence
attcatttgaacct

SEQ ID NO: 1980 - DNA, 14 bp, Artificial sequence
  synthetic sequence
gtccctcttgttag

SEQ ID NO: 1981 - DNA, 14 bp, Artificial sequence
  synthetic sequence
ctttcgtcactggt

SEQ ID NO: 1982 - DNA, 14 bp, Artificial sequence
  synthetic sequence
agctattagatttg

SEQ ID NO: 1983 - DNA, 14 bp, Artificial sequence
  synthetic sequence
tatggcatagattt

SEQ ID NO: 1984 - DNA, 14 bp, Artificial sequence
  synthetic sequence
gttttgggggttgg

SEQ ID NO: 1985 - DNA, 14 bp, Artificial sequence
  synthetic sequence
ttgtaggttactag

SEQ ID NO: 1986 - DNA, 14 bp, Artificial sequence
  synthetic sequence
gtcttgcgcgttta

SEQ ID NO: 1987 - DNA, 14 bp, Artificial sequence
  synthetic sequence
acgtatgttactgt

SEQ ID NO: 1988 - DNA, 14 bp, Artificial sequence
  synthetic sequence
tcctgatatacttg

SEQ ID NO: 1989 - DNA, 14 bp, Artificial sequence
  synthetic sequence
gttttctaaatgac

SEQ ID NO: 1990 - DNA, 14 bp, Artificial sequence
  synthetic sequence
aaagtagcttattt

SEQ ID NO: 1991 - DNA, 14 bp, Artificial sequence
  synthetic sequence
tgtgtgaatgtact

SEQ ID NO: 1992 - DNA, 14 bp, Artificial sequence
  synthetic sequence
ttcactgattgact

SEQ ID NO: 1993 - DNA, 14 bp, Artificial sequence
  synthetic sequence
gtttactttggcgc

SEQ ID NO: 1994 - DNA, 14 bp, Artificial sequence
  synthetic sequence
aaggtaatctgttt

SEQ ID NO: 1995 - DNA, 14 bp, Artificial sequence
  synthetic sequence
atgagtagattttg

SEQ ID NO: 1996 - DNA, 14 bp, Artificial sequence
  synthetic sequence
ttttcaaccctatg

SEQ ID NO: 1997 - DNA, 14 bp, Artificial sequence
  synthetic sequence
tccattcgtgatat

SEQ ID NO: 1998 - DNA, 14 bp, Artificial sequence
  synthetic sequence
tgaatcactctgtt

SEQ ID NO: 1999 - DNA, 14 bp, Artificial sequence
  synthetic sequence
tttgtggaatagtc

SEQ ID NO: 2000 - DNA, 14 bp, Artificial sequence
  synthetic sequence
gtacgttttcacct

SEQ ID NO: 2001 - DNA, 14 bp, Artificial sequence
  synthetic sequence
ttctcgatccgttc

SEQ ID NO: 2002 - DNA, 14 bp, Artificial sequence
  synthetic sequence
atttatggtggtga

SEQ ID NO: 2003 - DNA, 14 bp, Artificial sequence
  synthetic sequence
cttaagcttattaa

SEQ ID NO: 2004 - DNA, 14 bp, Artificial sequence
  synthetic sequence
agattctgatgtat

SEQ ID NO: 2005 - DNA, 14 bp, Artificial sequence
  synthetic sequence
tttaaaggtatgtg

SEQ ID NO: 2006 - DNA, 14 bp, Artificial sequence
  synthetic sequence
ttggttcgcactat

SEQ ID NO: 2007 - DNA, 14 bp, Artificial sequence
  synthetic sequence
tagttctcataaat

SEQ ID NO: 2008 - DNA, 14 bp, Artificial sequence
  synthetic sequence
atattgtacttcgc

SEQ ID NO: 2009 - DNA, 14 bp, Artificial sequence
  synthetic sequence
ctagctgtcctttc

SEQ ID NO: 2010 - DNA, 14 bp, Artificial sequence
  synthetic sequence
ctttatggccgttc

SEQ ID NO: 2011 - DNA, 14 bp, Artificial sequence
  synthetic sequence
tggtcttaacttca

SEQ ID NO: 2012 - DNA, 14 bp, Artificial sequence
  synthetic sequence
cattctagggttct

SEQ ID NO: 2013 - DNA, 14 bp, Artificial sequence
  synthetic sequence
tttgcatccacttg

SEQ ID NO: 2014 - DNA, 14 bp, Artificial sequence
  synthetic sequence
gtatgaagttttcg

SEQ ID NO: 2015 - DNA, 14 bp, Artificial sequence
  synthetic sequence
tttacagttcatca

SEQ ID NO: 2016 - DNA, 14 bp, Artificial sequence
  synthetic sequence
tttagattcccaat

SEQ ID NO: 2017 - DNA, 14 bp, Artificial sequence
  synthetic sequence
ttagctagtttgga

SEQ ID NO: 2018 - DNA, 14 bp, Artificial sequence
  synthetic sequence
tcgtgtcattagta

SEQ ID NO: 2019 - DNA, 14 bp, Artificial sequence
  synthetic sequence
gttttccagtctgt

SEQ ID NO: 2020 - DNA, 14 bp, Artificial sequence
  synthetic sequence
gttatttgttcgag

SEQ ID NO: 2021 - DNA, 14 bp, Artificial sequence
  synthetic sequence
agtagttttccttg

SEQ ID NO: 2022 - DNA, 14 bp, Artificial sequence
  synthetic sequence
tcatttctgttcca

SEQ ID NO: 2023 - DNA, 14 bp, Artificial sequence
  synthetic sequence
gtatgcattatttc

SEQ ID NO: 2024 - DNA, 14 bp, Artificial sequence
  synthetic sequence
tgttagtggtctct

SEQ ID NO: 2025 - DNA, 14 bp, Artificial sequence
  synthetic sequence
atgttgatccttat

SEQ ID NO: 2026 - DNA, 14 bp, Artificial sequence
  synthetic sequence
tctttctctaatgc

SEQ ID NO: 2027 - DNA, 14 bp, Artificial sequence
  synthetic sequence
ttggtattcctatc

SEQ ID NO: 2028 - DNA, 14 bp, Artificial sequence
  synthetic sequence
cttgtgattctgta

SEQ ID NO: 2029 - DNA, 14 bp, Artificial sequence
  synthetic sequence
ttattactcggatt

SEQ ID NO: 2030 - DNA, 14 bp, Artificial sequence
  synthetic sequence
atttgtgggattgt

SEQ ID NO: 2031 - DNA, 14 bp, Artificial sequence
  synthetic sequence
tacttgatgtcctt

SEQ ID NO: 2032 - DNA, 14 bp, Artificial sequence
  synthetic sequence
gtaggctcattttt

SEQ ID NO: 2033 - DNA, 14 bp, Artificial sequence
  synthetic sequence
ctttcatttagtag

SEQ ID NO: 2034 - DNA, 14 bp, Artificial sequence
  synthetic sequence
ggattcttttaagt

SEQ ID NO: 2035 - DNA, 14 bp, Artificial sequence
  synthetic sequence
atttcttgactact

SEQ ID NO: 2036 - DNA, 14 bp, Artificial sequence
  synthetic sequence
tcatggtatttgct

SEQ ID NO: 2037 - DNA, 14 bp, Artificial sequence
  synthetic sequence
catttatgttccgt

SEQ ID NO: 2038 - DNA, 14 bp, Artificial sequence
  synthetic sequence
ttcgtgttaattgc

SEQ ID NO: 2039 - DNA, 14 bp, Artificial sequence
  synthetic sequence
atctaggtttgtgt

SEQ ID NO: 2040 - DNA, 14 bp, Artificial sequence
  synthetic sequence
gtatgattctctta

SEQ ID NO: 2041 - DNA, 14 bp, Artificial sequence
  synthetic sequence
tcctgtttcttaga

SEQ ID NO: 2042 - DNA, 14 bp, Artificial sequence
  synthetic sequence
ttcatgtttcactc

SEQ ID NO: 2043 - DNA, 14 bp, Artificial sequence
  synthetic sequence
ctggttattccctt

SEQ ID NO: 2044 - DNA, 14 bp, Artificial sequence
  synthetic sequence
acccttctattttg

SEQ ID NO: 2045 - DNA, 14 bp, Artificial sequence
  synthetic sequence
ccgtttcgctttgt

SEQ ID NO: 2046 - DNA, 14 bp, Artificial sequence
  synthetic sequence
atgattctttcagt

SEQ ID NO: 2047 - DNA, 14 bp, Artificial sequence
  synthetic sequence
ttggtttgctgtga

SEQ ID NO: 2048 - DNA, 14 bp, Artificial sequence
  synthetic sequence
gtctggtatattgt

SEQ ID NO: 2049 - DNA, 14 bp, Artificial sequence
  synthetic sequence
attgcatcatttct

SEQ ID NO: 2050 - DNA, 14 bp, Artificial sequence
  synthetic sequence
ttggatttttggac

SEQ ID NO: 2051 - DNA, 14 bp, Artificial sequence
  synthetic sequence
ccctttttgaactt

SEQ ID NO: 2052 - DNA, 14 bp, Artificial sequence
  synthetic sequence
ctcttagtgtttcc

SEQ ID NO: 2053 - DNA, 14 bp, Artificial sequence
  synthetic sequence
tcgttcctttccgt

SEQ ID NO: 2054 - DNA, 14 bp, Artificial sequence
  synthetic sequence
tgttacggttttcg

SEQ ID NO: 2055 - DNA, 14 bp, Artificial sequence
  synthetic sequence
ttcctttttagaac

SEQ ID NO: 2056 - DNA, 14 bp, Artificial sequence
  synthetic sequence
tggttagtttaatc

SEQ ID NO: 2057 - DNA, 14 bp, Artificial sequence
  synthetic sequence
cttagtcttgtctc

SEQ ID NO: 2058 - DNA, 14 bp, Artificial sequence
  synthetic sequence
tgttgttatcaatg

SEQ ID NO: 2059 - DNA, 14 bp, Artificial sequence
  synthetic sequence
atttttagatcgtg

SEQ ID NO: 2060 - DNA, 14 bp, Artificial sequence
  synthetic sequence
ttgtttatggtgga

SEQ ID NO: 2061 - DNA, 14 bp, Artificial sequence
  synthetic sequence
tacatagagttttt

SEQ ID NO: 2062 - DNA, 14 bp, Artificial sequence
  synthetic sequence
ttttccttcgcgtc

SEQ ID NO: 2063 - DNA, 14 bp, Artificial sequence
  synthetic sequence
cggttttattactg

SEQ ID NO: 2064 - DNA, 14 bp, Artificial sequence
  synthetic sequence
taatagtgctttta

SEQ ID NO: 2065 - DNA, 14 bp, Artificial sequence
  synthetic sequence
gttgatatgtatat

SEQ ID NO: 2066 - DNA, 14 bp, Artificial sequence
  synthetic sequence
caagttgatttctt

SEQ ID NO: 2067 - DNA, 14 bp, Artificial sequence
  synthetic sequence
ttattgtcttcaca

SEQ ID NO: 2068 - DNA, 14 bp, Artificial sequence
  synthetic sequence
aggtattttgtgtg

SEQ ID NO: 2069 - DNA, 14 bp, Artificial sequence
  synthetic sequence
cctctcctctttat

SEQ ID NO: 2070 - DNA, 14 bp, Artificial sequence
  synthetic sequence
tttaggttggtcta

SEQ ID NO: 2071 - DNA, 14 bp, Artificial sequence
  synthetic sequence
cggtctctttgttc

SEQ ID NO: 2072 - DNA, 14 bp, Artificial sequence
  synthetic sequence
tgttatgtaacctt

SEQ ID NO: 2073 - DNA, 14 bp, Artificial sequence
  synthetic sequence
ctttattcgagtct

SEQ ID NO: 2074 - DNA, 14 bp, Artificial sequence
  synthetic sequence
ggtatactttcctt

SEQ ID NO: 2075 - DNA, 14 bp, Artificial sequence
  synthetic sequence
cagcttgtgttgtt

SEQ ID NO: 2076 - DNA, 14 bp, Artificial sequence
  synthetic sequence
ttgcgctttcgctt

SEQ ID NO: 2077 - DNA, 14 bp, Artificial sequence
  synthetic sequence
tagtctatttgact

SEQ ID NO: 2078 - DNA, 14 bp, Artificial sequence
  synthetic sequence
gtcgttggtttttg

SEQ ID NO: 2079 - DNA, 14 bp, Artificial sequence
  synthetic sequence
ggtttattgattta

SEQ ID NO: 2080 - DNA, 14 bp, Artificial sequence
  synthetic sequence
gtttttatgctata

SEQ ID NO: 2081 - DNA, 14 bp, Artificial sequence
  synthetic sequence
tgctattttcggtt

SEQ ID NO: 2082 - DNA, 14 bp, Artificial sequence
  synthetic sequence
tattgtcttttcac

SEQ ID NO: 2083 - DNA, 14 bp, Artificial sequence
  synthetic sequence
ttgtcctgggtttt

SEQ ID NO: 2084 - DNA, 14 bp, Artificial sequence
  synthetic sequence
tcttttggctgttg

SEQ ID NO: 2085 - DNA, 14 bp, Artificial sequence
  synthetic sequence
acttcgactttttt

SEQ ID NO: 2086 - DNA, 14 bp, Artificial sequence
  synthetic sequence
tgcttttcttacct

SEQ ID NO: 2087 - DNA, 14 bp, Artificial sequence
  synthetic sequence
atgatcctttttta

SEQ ID NO: 2088 - DNA, 14 bp, Artificial sequence
  synthetic sequence
tttctattgtgtgc

SEQ ID NO: 2089 - DNA, 14 bp, Artificial sequence
  synthetic sequence
tatttcctatactt

SEQ ID NO: 2090 - DNA, 14 bp, Artificial sequence
  synthetic sequence
gtttgtttattgag

SEQ ID NO: 2091 - DNA, 14 bp, Artificial sequence
  synthetic sequence
ggattgttttcttc

SEQ ID NO: 2092 - DNA, 14 bp, Artificial sequence
  synthetic sequence
tgtatccattttgt

SEQ ID NO: 2093 - DNA, 14 bp, Artificial sequence
  synthetic sequence
cctattttctcgtt

SEQ ID NO: 2094 - DNA, 14 bp, Artificial sequence
  synthetic sequence
attcttactgtatt

SEQ ID NO: 2095 - DNA, 14 bp, Artificial sequence
  synthetic sequence
ttgagtttatcttc

SEQ ID NO: 2096 - DNA, 14 bp, Artificial sequence
  synthetic sequence
cttcttctcttctg

SEQ ID NO: 2097 - DNA, 14 bp, Artificial sequence
  synthetic sequence
ttgtgttctataat

SEQ ID NO: 2098 - DNA, 14 bp, Artificial sequence
  synthetic sequence
gtttgaaatctttt

SEQ ID NO: 2099 - DNA, 14 bp, Artificial sequence
  synthetic sequence
gtcctttgatgttt

SEQ ID NO: 2100 - DNA, 14 bp, Artificial sequence
  synthetic sequence
tgtatattgttgct

SEQ ID NO: 2101 - DNA, 14 bp, Artificial sequence
  synthetic sequence
ttgtctcgttgtgt

SEQ ID NO: 2102 - DNA, 14 bp, Artificial sequence
  synthetic sequence
tcgtactatttttc

SEQ ID NO: 2103 - DNA, 14 bp, Artificial sequence
  synthetic sequence
cttttattacctta

SEQ ID NO: 2104 - DNA, 14 bp, Artificial sequence
  synthetic sequence
tcagtcttgctttt

SEQ ID NO: 2105 - DNA, 14 bp, Artificial sequence
  synthetic sequence
ggcagcaactcggg

SEQ ID NO: 2106 - DNA, 14 bp, Artificial sequence
  synthetic sequence
ccgcctacagaggg

SEQ ID NO: 2107 - DNA, 14 bp, Artificial sequence
  synthetic sequence
ggagataggcgccc

SEQ ID NO: 2108 - DNA, 14 bp, Artificial sequence
  synthetic sequence
caagtggccggcgg

SEQ ID NO: 2109 - DNA, 14 bp, Artificial sequence
  synthetic sequence
gcgacgaggccact

SEQ ID NO: 2110 - DNA, 14 bp, Artificial sequence
  synthetic sequence
agcgagacggtgcc

SEQ ID NO: 2111 - DNA, 14 bp, Artificial sequence
  synthetic sequence
tcggcagaacgccg

SEQ ID NO: 2112 - DNA, 14 bp, Artificial sequence
  synthetic sequence
ccgaaccgggtgaa

SEQ ID NO: 2113 - DNA, 14 bp, Artificial sequence
  synthetic sequence
gaccaatacacgcc

SEQ ID NO: 2114 - DNA, 14 bp, Artificial sequence
  synthetic sequence
aggagccggtaaaa

SEQ ID NO: 2115 - DNA, 14 bp, Artificial sequence
  synthetic sequence
cagtagcccgagaa

SEQ ID NO: 2116 - DNA, 14 bp, Artificial sequence
  synthetic sequence
cgcacacatcacgc

SEQ ID NO: 2117 - DNA, 14 bp, Artificial sequence
  synthetic sequence
gctcagcgccaaag

SEQ ID NO: 2118 - DNA, 14 bp, Artificial sequence
  synthetic sequence
gagaaacaagatgc

SEQ ID NO: 2119 - DNA, 14 bp, Artificial sequence
  synthetic sequence
ccaaataacaaaag

SEQ ID NO: 2120 - DNA, 14 bp, Artificial sequence
  synthetic sequence
aacagcgacacggt

SEQ ID NO: 2121 - DNA, 14 bp, Artificial sequence
  synthetic sequence
accaagacgaccat

SEQ ID NO: 2122 - DNA, 14 bp, Artificial sequence
  synthetic sequence
gcaagaccctcacc

SEQ ID NO: 2123 - DNA, 14 bp, Artificial sequence
  synthetic sequence
accatcaccaagcc

SEQ ID NO: 2124 - DNA, 14 bp, Artificial sequence
  synthetic sequence
cgagaccctccaga

SEQ ID NO: 2125 - DNA, 14 bp, Artificial sequence
  synthetic sequence
gctccaggcagcca

SEQ ID NO: 2126 - DNA, 14 bp, Artificial sequence
  synthetic sequence
agctgaggaccaag

SEQ ID NO: 2127 - DNA, 14 bp, Artificial sequence
  synthetic sequence
ccaccctggacacg

SEQ ID NO: 2128 - DNA, 14 bp, Artificial sequence
  synthetic sequence
ccaggaaacaccta

SEQ ID NO: 2129 - DNA, 14 bp, Artificial sequence
  synthetic sequence
caggaatccggcca

SEQ ID NO: 2130 - DNA, 14 bp, Artificial sequence
  synthetic sequence
gtggccgaggcagg

SEQ ID NO: 2131 - DNA, 14 bp, Artificial sequence
  synthetic sequence
caaggcagcggtgc

SEQ ID NO: 2132 - DNA, 14 bp, Artificial sequence
  synthetic sequence
aagccgcacactcc

SEQ ID NO: 2133 - DNA, 14 bp, Artificial sequence
  synthetic sequence
agccaggcaactac

SEQ ID NO: 2134 - DNA, 14 bp, Artificial sequence
  synthetic sequence
ctccaagccccgga

SEQ ID NO: 2135 - DNA, 14 bp, Artificial sequence
  synthetic sequence
cgtgaaccccaccc

SEQ ID NO: 2136 - DNA, 14 bp, Artificial sequence
  synthetic sequence
gtacaagccggcca

SEQ ID NO: 2137 - DNA, 14 bp, Artificial sequence
  synthetic sequence
acagacgaacactc

SEQ ID NO: 2138 - DNA, 14 bp, Artificial sequence
  synthetic sequence
caaacaaagcgatg

SEQ ID NO: 2139 - DNA, 14 bp, Artificial sequence
  synthetic sequence
aagcggtgacaggc

SEQ ID NO: 2140 - DNA, 14 bp, Artificial sequence
  synthetic sequence
tagcacgccgacag

SEQ ID NO: 2141 - DNA, 14 bp, Artificial sequence
  synthetic sequence
gtaccccagcggac

SEQ ID NO: 2142 - DNA, 14 bp, Artificial sequence
  synthetic sequence
cacaggcggtgggc

SEQ ID NO: 2143 - DNA, 14 bp, Artificial sequence
  synthetic sequence
cacaggagacactc

SEQ ID NO: 2144 - DNA, 14 bp, Artificial sequence
  synthetic sequence
aagcaccatgcgga

SEQ ID NO: 2145 - DNA, 14 bp, Artificial sequence
  synthetic sequence
gcactaccaggcaa

SEQ ID NO: 2146 - DNA, 14 bp, Artificial sequence
  synthetic sequence
ggcgagggaggtca

SEQ ID NO: 2147 - DNA, 14 bp, Artificial sequence
  synthetic sequence
ggtacaaacaaccg

SEQ ID NO: 2148 - DNA, 14 bp, Artificial sequence
  synthetic sequence
ggcactgctgacaa

SEQ ID NO: 2149 - DNA, 14 bp, Artificial sequence
  synthetic sequence
ctaaccacactcaa

SEQ ID NO: 2150 - DNA, 14 bp, Artificial sequence
  synthetic sequence
cgctgcatgggacc

SEQ ID NO: 2151 - DNA, 14 bp, Artificial sequence
  synthetic sequence
gagcatacgcatag

SEQ ID NO: 2152 - DNA, 14 bp, Artificial sequence
  synthetic sequence
aagacctaaagact

SEQ ID NO: 2153 - DNA, 14 bp, Artificial sequence
  synthetic sequence
ggccaaatccactg

SEQ ID NO: 2154 - DNA, 14 bp, Artificial sequence
  synthetic sequence
aattggaacgcgcc

SEQ ID NO: 2155 - DNA, 14 bp, Artificial sequence
  synthetic sequence
cgcgagctaccggt

SEQ ID NO: 2156 - DNA, 14 bp, Artificial sequence
  synthetic sequence
atcgcagggcgtgc

SEQ ID NO: 2157 - DNA, 14 bp, Artificial sequence
  synthetic sequence
agggaccttcaaca

SEQ ID NO: 2158 - DNA, 14 bp, Artificial sequence
  synthetic sequence
agagacctcggctg

SEQ ID NO: 2159 - DNA, 14 bp, Artificial sequence
  synthetic sequence
cccgacccgttcag

SEQ ID NO: 2160 - DNA, 14 bp, Artificial sequence
  synthetic sequence
acttcaccgcaaag

SEQ ID NO: 2161 - DNA, 14 bp, Artificial sequence
  synthetic sequence
atgaaaaactggcc

SEQ ID NO: 2162 - DNA, 14 bp, Artificial sequence
  synthetic sequence
cgcgtacgctaacg

SEQ ID NO: 2163 - DNA, 14 bp, Artificial sequence
  synthetic sequence
gctcccgctcagga

SEQ ID NO: 2164 - DNA, 14 bp, Artificial sequence
  synthetic sequence
agtcgacctgagca

SEQ ID NO: 2165 - DNA, 14 bp, Artificial sequence
  synthetic sequence
aaacgaagcggctt

SEQ ID NO: 2166 - DNA, 14 bp, Artificial sequence
  synthetic sequence
cgcaactaggatac

SEQ ID NO: 2167 - DNA, 14 bp, Artificial sequence
  synthetic sequence
cgtatggaaaacag

SEQ ID NO: 2168 - DNA, 14 bp, Artificial sequence
  synthetic sequence
cgcagtcggtccag

SEQ ID NO: 2169 - DNA, 14 bp, Artificial sequence
  synthetic sequence
aagcgtcgtacggg

SEQ ID NO: 2170 - DNA, 14 bp, Artificial sequence
  synthetic sequence
gccggtgcgtaaac

SEQ ID NO: 2171 - DNA, 14 bp, Artificial sequence
  synthetic sequence
ggactacacacgtg

SEQ ID NO: 2172 - DNA, 14 bp, Artificial sequence
  synthetic sequence
cgtgaacgaagtca

SEQ ID NO: 2173 - DNA, 14 bp, Artificial sequence
  synthetic sequence
cataccggacacct

SEQ ID NO: 2174 - DNA, 14 bp, Artificial sequence
  synthetic sequence
cagtaagcccaatg

SEQ ID NO: 2175 - DNA, 14 bp, Artificial sequence
  synthetic sequence
ctcgaagcctacgg

SEQ ID NO: 2176 - DNA, 14 bp, Artificial sequence
  synthetic sequence
ggaatggcgtacca

SEQ ID NO: 2177 - DNA, 14 bp, Artificial sequence
  synthetic sequence
ggtcgagggacgta

SEQ ID NO: 2178 - DNA, 14 bp, Artificial sequence
  synthetic sequence
acgtgagatagcac

SEQ ID NO: 2179 - DNA, 14 bp, Artificial sequence
  synthetic sequence
tgagacatcccgag

SEQ ID NO: 2180 - DNA, 14 bp, Artificial sequence
  synthetic sequence
gtccgcgataagcg

SEQ ID NO: 2181 - DNA, 14 bp, Artificial sequence
  synthetic sequence
gaactggctcaagg

SEQ ID NO: 2182 - DNA, 14 bp, Artificial sequence
  synthetic sequence
cataggtagggcac

SEQ ID NO: 2183 - DNA, 14 bp, Artificial sequence
  synthetic sequence
caatgatgcgaaac

SEQ ID NO: 2184 - DNA, 14 bp, Artificial sequence
  synthetic sequence
gtgcccgtcccaag

SEQ ID NO: 2185 - DNA, 14 bp, Artificial sequence
  synthetic sequence
acgacacgcgttga

SEQ ID NO: 2186 - DNA, 14 bp, Artificial sequence
  synthetic sequence
cttcagacaaacac

SEQ ID NO: 2187 - DNA, 14 bp, Artificial sequence
  synthetic sequence
gagaagaagcttac

SEQ ID NO: 2188 - DNA, 14 bp, Artificial sequence
  synthetic sequence
ggaggtctaagcgg

SEQ ID NO: 2189 - DNA, 14 bp, Artificial sequence
  synthetic sequence
aagcccgacatgta

SEQ ID NO: 2190 - DNA, 14 bp, Artificial sequence
  synthetic sequence
gaagcgaggttcca

SEQ ID NO: 2191 - DNA, 14 bp, Artificial sequence
  synthetic sequence
accgatcgtatcgc

SEQ ID NO: 2192 - DNA, 14 bp, Artificial sequence
  synthetic sequence
ctatacggcctacc

SEQ ID NO: 2193 - DNA, 14 bp, Artificial sequence
  synthetic sequence
gctaacacggcttc

SEQ ID NO: 2194 - DNA, 14 bp, Artificial sequence
  synthetic sequence
acgtaggagcgtat

SEQ ID NO: 2195 - DNA, 14 bp, Artificial sequence
  synthetic sequence
ggatgggctagatc

SEQ ID NO: 2196 - DNA, 14 bp, Artificial sequence
  synthetic sequence
cctaatgtggccca

SEQ ID NO: 2197 - DNA, 14 bp, Artificial sequence
  synthetic sequence
ggtgagttacacac

SEQ ID NO: 2198 - DNA, 14 bp, Artificial sequence
  synthetic sequence
aagctacctcacct

SEQ ID NO: 2199 - DNA, 14 bp, Artificial sequence
  synthetic sequence
gcacattcgatgac

SEQ ID NO: 2200 - DNA, 14 bp, Artificial sequence
  synthetic sequence
caatcgctaatcgc

SEQ ID NO: 2201 - DNA, 14 bp, Artificial sequence
  synthetic sequence
gcgctggcttcgga

SEQ ID NO: 2202 - DNA, 14 bp, Artificial sequence
  synthetic sequence
tgcgtcgggtaaca

SEQ ID NO: 2203 - DNA, 14 bp, Artificial sequence
  synthetic sequence
ctgggaacagttcc

SEQ ID NO: 2204 - DNA, 14 bp, Artificial sequence
  synthetic sequence
agagctgcactggt

SEQ ID NO: 2205 - DNA, 14 bp, Artificial sequence
  synthetic sequence
gaactaacttgccc

SEQ ID NO: 2206 - DNA, 14 bp, Artificial sequence
  synthetic sequence
tgagtacccagcct

SEQ ID NO: 2207 - DNA, 14 bp, Artificial sequence
  synthetic sequence
ctcgctgacggctg

SEQ ID NO: 2208 - DNA, 14 bp, Artificial sequence
  synthetic sequence
ccaatatccgcatg

SEQ ID NO: 2209 - DNA, 14 bp, Artificial sequence
  synthetic sequence
tagaatgacaatga

SEQ ID NO: 2210 - DNA, 14 bp, Artificial sequence
  synthetic sequence
tcagcgtagtagga

SEQ ID NO: 2211 - DNA, 14 bp, Artificial sequence
  synthetic sequence
taccgcgactccat

SEQ ID NO: 2212 - DNA, 14 bp, Artificial sequence
  synthetic sequence
ctaggtactcgcca

SEQ ID NO: 2213 - DNA, 14 bp, Artificial sequence
  synthetic sequence
ccgtcggtgtcgcg

SEQ ID NO: 2214 - DNA, 14 bp, Artificial sequence
  synthetic sequence
gaagacctacggtt

SEQ ID NO: 2215 - DNA, 14 bp, Artificial sequence
  synthetic sequence
gaatgtcactgaaa

SEQ ID NO: 2216 - DNA, 14 bp, Artificial sequence
  synthetic sequence
acaaactaaatcct

SEQ ID NO: 2217 - DNA, 14 bp, Artificial sequence
  synthetic sequence
tgtggtggcggcca

SEQ ID NO: 2218 - DNA, 14 bp, Artificial sequence
  synthetic sequence
tatatccgcaaccc

SEQ ID NO: 2219 - DNA, 14 bp, Artificial sequence
  synthetic sequence
tcgctataaggaca

SEQ ID NO: 2220 - DNA, 14 bp, Artificial sequence
  synthetic sequence
atccagacgcgtta

SEQ ID NO: 2221 - DNA, 14 bp, Artificial sequence
  synthetic sequence
catatcccaccata

SEQ ID NO: 2222 - DNA, 14 bp, Artificial sequence
  synthetic sequence
tccgaggcccttga

SEQ ID NO: 2223 - DNA, 14 bp, Artificial sequence
  synthetic sequence
caagctgggggtgt

SEQ ID NO: 2224 - DNA, 14 bp, Artificial sequence
  synthetic sequence
gtgaaatcagtgag

SEQ ID NO: 2225 - DNA, 14 bp, Artificial sequence
  synthetic sequence
gggattacataacg

SEQ ID NO: 2226 - DNA, 14 bp, Artificial sequence
  synthetic sequence
gatccctgccggta

SEQ ID NO: 2227 - DNA, 14 bp, Artificial sequence
  synthetic sequence
acactcccattgaa

SEQ ID NO: 2228 - DNA, 14 bp, Artificial sequence
  synthetic sequence
ctggaccggagtta

SEQ ID NO: 2229 - DNA, 14 bp, Artificial sequence
  synthetic sequence
cgacagcttatggc

SEQ ID NO: 2230 - DNA, 14 bp, Artificial sequence
  synthetic sequence
aggtgggtgcctcc

SEQ ID NO: 2231 - DNA, 14 bp, Artificial sequence
  synthetic sequence
acgaccgcctttag

SEQ ID NO: 2232 - DNA, 14 bp, Artificial sequence
  synthetic sequence
tgggagtactgcca

SEQ ID NO: 2233 - DNA, 14 bp, Artificial sequence
  synthetic sequence
gcgtaggatccatg

SEQ ID NO: 2234 - DNA, 14 bp, Artificial sequence
  synthetic sequence
aatagtgcgctgaa

SEQ ID NO: 2235 - DNA, 14 bp, Artificial sequence
  synthetic sequence
gacaggtatcaact

SEQ ID NO: 2236 - DNA, 14 bp, Artificial sequence
  synthetic sequence
gaatcacttcaagc

SEQ ID NO: 2237 - DNA, 14 bp, Artificial sequence
  synthetic sequence
cactataaaactgg

SEQ ID NO: 2238 - DNA, 14 bp, Artificial sequence
  synthetic sequence
atggaaactacgct

SEQ ID NO: 2239 - DNA, 14 bp, Artificial sequence
  synthetic sequence
gcgtcgcattgcgc

SEQ ID NO: 2240 - DNA, 14 bp, Artificial sequence
  synthetic sequence
cctgggtatagcga

SEQ ID NO: 2241 - DNA, 14 bp, Artificial sequence
  synthetic sequence
cggactgggtaatg

SEQ ID NO: 2242 - DNA, 14 bp, Artificial sequence
  synthetic sequence
ccacctgtacggtc

SEQ ID NO: 2243 - DNA, 14 bp, Artificial sequence
  synthetic sequence
gtggccatggatag

SEQ ID NO: 2244 - DNA, 14 bp, Artificial sequence
  synthetic sequence
ccaagttacgagat

SEQ ID NO: 2245 - DNA, 14 bp, Artificial sequence
  synthetic sequence
caagggtgagggtt

SEQ ID NO: 2246 - DNA, 14 bp, Artificial sequence
  synthetic sequence
cgctaaggacgtgt

SEQ ID NO: 2247 - DNA, 14 bp, Artificial sequence
  synthetic sequence
agttataagaagca

SEQ ID NO: 2248 - DNA, 14 bp, Artificial sequence
  synthetic sequence
tgtgacagacgcta

SEQ ID NO: 2249 - DNA, 14 bp, Artificial sequence
  synthetic sequence
ggagggcattgctg

SEQ ID NO: 2250 - DNA, 14 bp, Artificial sequence
  synthetic sequence
ccctgtgataaagg

SEQ ID NO: 2251 - DNA, 14 bp, Artificial sequence
  synthetic sequence
cgccttaaagctaa

SEQ ID NO: 2252 - DNA, 14 bp, Artificial sequence
  synthetic sequence
cataagagtatgca

SEQ ID NO: 2253 - DNA, 14 bp, Artificial sequence
  synthetic sequence
tgaagcgagagatt

SEQ ID NO: 2254 - DNA, 14 bp, Artificial sequence
  synthetic sequence
acgagcgttcacat

SEQ ID NO: 2255 - DNA, 14 bp, Artificial sequence
  synthetic sequence
gatgccaagtatcg

SEQ ID NO: 2256 - DNA, 14 bp, Artificial sequence
  synthetic sequence
gggctgccccatgt

SEQ ID NO: 2257 - DNA, 14 bp, Artificial sequence
  synthetic sequence
gcaacctaactagt

SEQ ID NO: 2258 - DNA, 14 bp, Artificial sequence
  synthetic sequence
ctgcctctcggccg

SEQ ID NO: 2259 - DNA, 14 bp, Artificial sequence
  synthetic sequence
cgcgcagtgttcgg

SEQ ID NO: 2260 - DNA, 14 bp, Artificial sequence
  synthetic sequence
cgacggggttactc

SEQ ID NO: 2261 - DNA, 14 bp, Artificial sequence
  synthetic sequence
gtgaaacttcggca

SEQ ID NO: 2262 - DNA, 14 bp, Artificial sequence
  synthetic sequence
ctactaccctaccg

SEQ ID NO: 2263 - DNA, 14 bp, Artificial sequence
  synthetic sequence
aactaagtatggga

SEQ ID NO: 2264 - DNA, 14 bp, Artificial sequence
  synthetic sequence
ccggatgtgatggg

SEQ ID NO: 2265 - DNA, 14 bp, Artificial sequence
  synthetic sequence
taaaacaacctgtg

SEQ ID NO: 2266 - DNA, 14 bp, Artificial sequence
  synthetic sequence
caagaatatgtgca

SEQ ID NO: 2267 - DNA, 14 bp, Artificial sequence
  synthetic sequence
caacgtggtcccgt

SEQ ID NO: 2268 - DNA, 14 bp, Artificial sequence
  synthetic sequence
agtggaaagccttg

SEQ ID NO: 2269 - DNA, 14 bp, Artificial sequence
  synthetic sequence
cccgatgtagcgat

SEQ ID NO: 2270 - DNA, 14 bp, Artificial sequence
  synthetic sequence
caccgctctataag

SEQ ID NO: 2271 - DNA, 14 bp, Artificial sequence
  synthetic sequence
cccgagttgtcaaa

SEQ ID NO: 2272 - DNA, 14 bp, Artificial sequence
  synthetic sequence
aacgcccttcctca

SEQ ID NO: 2273 - DNA, 14 bp, Artificial sequence
  synthetic sequence
atatccacggatga

SEQ ID NO: 2274 - DNA, 14 bp, Artificial sequence
  synthetic sequence
actagatcatcgga

SEQ ID NO: 2275 - DNA, 14 bp, Artificial sequence
  synthetic sequence
gtagcggcatggtc

SEQ ID NO: 2276 - DNA, 14 bp, Artificial sequence
  synthetic sequence
ttgggcgaacacgt

SEQ ID NO: 2277 - DNA, 14 bp, Artificial sequence
  synthetic sequence
ggttggtccacggt

SEQ ID NO: 2278 - DNA, 14 bp, Artificial sequence
  synthetic sequence
atgggcctcaaatt

SEQ ID NO: 2279 - DNA, 14 bp, Artificial sequence
  synthetic sequence
gatatcaccctgat

SEQ ID NO: 2280 - DNA, 14 bp, Artificial sequence
  synthetic sequence
cgtggtaaccttcg

SEQ ID NO: 2281 - DNA, 14 bp, Artificial sequence
  synthetic sequence
gctttatagcgaga

SEQ ID NO: 2282 - DNA, 14 bp, Artificial sequence
  synthetic sequence
attctacgtgaacg

SEQ ID NO: 2283 - DNA, 14 bp, Artificial sequence
  synthetic sequence
atggacatgtgatg

SEQ ID NO: 2284 - DNA, 14 bp, Artificial sequence
  synthetic sequence
gtggggctctccct

SEQ ID NO: 2285 - DNA, 14 bp, Artificial sequence
  synthetic sequence
cccgtcagtgctct

SEQ ID NO: 2286 - DNA, 14 bp, Artificial sequence
  synthetic sequence
atatccaaagcctt

SEQ ID NO: 2287 - DNA, 14 bp, Artificial sequence
  synthetic sequence
ttgctagaagcgtg

SEQ ID NO: 2288 - DNA, 14 bp, Artificial sequence
  synthetic sequence
tagcttacaatccg

SEQ ID NO: 2289 - DNA, 14 bp, Artificial sequence
  synthetic sequence
gggtcatccgtgct

SEQ ID NO: 2290 - DNA, 14 bp, Artificial sequence
  synthetic sequence
agtgtcactatggg

SEQ ID NO: 2291 - DNA, 14 bp, Artificial sequence
  synthetic sequence
tacgtagtagccat

SEQ ID NO: 2292 - DNA, 14 bp, Artificial sequence
  synthetic sequence
ataccatggttaac

SEQ ID NO: 2293 - DNA, 14 bp, Artificial sequence
  synthetic sequence
cttctccgatccaa

SEQ ID NO: 2294 - DNA, 14 bp, Artificial sequence
  synthetic sequence
ggccttttaccccg

SEQ ID NO: 2295 - DNA, 14 bp, Artificial sequence
  synthetic sequence
tgaaacttctcaac

SEQ ID NO: 2296 - DNA, 14 bp, Artificial sequence
  synthetic sequence
ttagaactggatac

SEQ ID NO: 2297 - DNA, 14 bp, Artificial sequence
  synthetic sequence
tgaacattagtaac

SEQ ID NO: 2298 - DNA, 14 bp, Artificial sequence
  synthetic sequence
gaatgaatacctgt

SEQ ID NO: 2299 - DNA, 14 bp, Artificial sequence
  synthetic sequence
aactcaatgccttg

SEQ ID NO: 2300 - DNA, 14 bp, Artificial sequence
  synthetic sequence
gttgcgcagttgag

SEQ ID NO: 2301 - DNA, 14 bp, Artificial sequence
  synthetic sequence
gcgtcgattgtacc

SEQ ID NO: 2302 - DNA, 14 bp, Artificial sequence
  synthetic sequence
tcgaaaaagtgtat

SEQ ID NO: 2303 - DNA, 14 bp, Artificial sequence
  synthetic sequence
gtcacgcggtcctt

SEQ ID NO: 2304 - DNA, 14 bp, Artificial sequence
  synthetic sequence
tttaatcgaaagac

SEQ ID NO: 2305 - DNA, 14 bp, Artificial sequence
  synthetic sequence
ctaggctggatact

SEQ ID NO: 2306 - DNA, 14 bp, Artificial sequence
  synthetic sequence
aggagtcaatgctt

SEQ ID NO: 2307 - DNA, 14 bp, Artificial sequence
  synthetic sequence
tctagggttaggca

SEQ ID NO: 2308 - DNA, 14 bp, Artificial sequence
  synthetic sequence
ctcctcacaggtgt

SEQ ID NO: 2309 - DNA, 14 bp, Artificial sequence
  synthetic sequence
tctcatcccacatc

SEQ ID NO: 2310 - DNA, 14 bp, Artificial sequence
  synthetic sequence
tagtgaggcgattg

SEQ ID NO: 2311 - DNA, 14 bp, Artificial sequence
  synthetic sequence
ctaagggctgcatt

SEQ ID NO: 2312 - DNA, 14 bp, Artificial sequence
  synthetic sequence
aaaatcactgttac

SEQ ID NO: 2313 - DNA, 14 bp, Artificial sequence
  synthetic sequence
ggtttggtaacgga

SEQ ID NO: 2314 - DNA, 14 bp, Artificial sequence
  synthetic sequence
cagttatataagcg

SEQ ID NO: 2315 - DNA, 14 bp, Artificial sequence
  synthetic sequence
agcataatcatgct

SEQ ID NO: 2316 - DNA, 14 bp, Artificial sequence
  synthetic sequence
agtctctaagatcc

SEQ ID NO: 2317 - DNA, 14 bp, Artificial sequence
  synthetic sequence
tgtaactccggcta

SEQ ID NO: 2318 - DNA, 14 bp, Artificial sequence
  synthetic sequence
gactcgttagccat

SEQ ID NO: 2319 - DNA, 14 bp, Artificial sequence
  synthetic sequence
ggtcggttgcccta

SEQ ID NO: 2320 - DNA, 14 bp, Artificial sequence
  synthetic sequence
gtggcagtgattac

SEQ ID NO: 2321 - DNA, 14 bp, Artificial sequence
  synthetic sequence
gtagccgtcatcgt

SEQ ID NO: 2322 - DNA, 14 bp, Artificial sequence
  synthetic sequence
tagatcgctaactg

SEQ ID NO: 2323 - DNA, 14 bp, Artificial sequence
  synthetic sequence
tcccaacatatagt

SEQ ID NO: 2324 - DNA, 14 bp, Artificial sequence
  synthetic sequence
tcctcgtactgtgg

SEQ ID NO: 2325 - DNA, 14 bp, Artificial sequence
  synthetic sequence
gttggtcagggtta

SEQ ID NO: 2326 - DNA, 14 bp, Artificial sequence
  synthetic sequence
ggttggacctttaa

SEQ ID NO: 2327 - DNA, 14 bp, Artificial sequence
  synthetic sequence
cctcctcctgctta

SEQ ID NO: 2328 - DNA, 14 bp, Artificial sequence
  synthetic sequence
tttccgactagtaa

SEQ ID NO: 2329 - DNA, 14 bp, Artificial sequence
  synthetic sequence
acgaattacgtatt

SEQ ID NO: 2330 - DNA, 14 bp, Artificial sequence
  synthetic sequence
gaacatcgtattta

SEQ ID NO: 2331 - DNA, 14 bp, Artificial sequence
  synthetic sequence
gtctcttacaactc

SEQ ID NO: 2332 - DNA, 14 bp, Artificial sequence
  synthetic sequence
ttctaatcacgctg

SEQ ID NO: 2333 - DNA, 14 bp, Artificial sequence
  synthetic sequence
ataatcagtactgt

SEQ ID NO: 2334 - DNA, 14 bp, Artificial sequence
  synthetic sequence
gggctaaacttttc

SEQ ID NO: 2335 - DNA, 14 bp, Artificial sequence
  synthetic sequence
atacactgagattt

SEQ ID NO: 2336 - DNA, 14 bp, Artificial sequence
  synthetic sequence
tgtctaagtcgtgg

SEQ ID NO: 2337 - DNA, 14 bp, Artificial sequence
  synthetic sequence
tttaactcacagtc

SEQ ID NO: 2338 - DNA, 14 bp, Artificial sequence
  synthetic sequence
atgtcttcaagcat

SEQ ID NO: 2339 - DNA, 14 bp, Artificial sequence
  synthetic sequence
ttcttgcaaagctc

SEQ ID NO: 2340 - DNA, 14 bp, Artificial sequence
  synthetic sequence
gtagtatataggtc

SEQ ID NO: 2341 - DNA, 14 bp, Artificial sequence
  synthetic sequence
aaatttctctacgg

SEQ ID NO: 2342 - DNA, 14 bp, Artificial sequence
  synthetic sequence
gtctccgctagtct

SEQ ID NO: 2343 - DNA, 14 bp, Artificial sequence
  synthetic sequence
tttcatccacgcgt

SEQ ID NO: 2344 - DNA, 14 bp, Artificial sequence
  synthetic sequence
gctcgaatctatct

SEQ ID NO: 2345 - DNA, 14 bp, Artificial sequence
  synthetic sequence
catgttcccgctat

SEQ ID NO: 2346 - DNA, 14 bp, Artificial sequence
  synthetic sequence
gtcttggacactct

SEQ ID NO: 2347 - DNA, 14 bp, Artificial sequence
  synthetic sequence
gtgaatcggtttca

SEQ ID NO: 2348 - DNA, 14 bp, Artificial sequence
  synthetic sequence
tacatgctttcgcc

SEQ ID NO: 2349 - DNA, 14 bp, Artificial sequence
  synthetic sequence
ggtggacttatcct

SEQ ID NO: 2350 - DNA, 14 bp, Artificial sequence
  synthetic sequence
cgcttggagttact

SEQ ID NO: 2351 - DNA, 14 bp, Artificial sequence
  synthetic sequence
tctgggtaccttgg

SEQ ID NO: 2352 - DNA, 14 bp, Artificial sequence
  synthetic sequence
cggagtattgattc

SEQ ID NO: 2353 - DNA, 14 bp, Artificial sequence
  synthetic sequence
cagttgaatgtgat

SEQ ID NO: 2354 - DNA, 14 bp, Artificial sequence
  synthetic sequence
gatataggcttgtc

SEQ ID NO: 2355 - DNA, 14 bp, Artificial sequence
  synthetic sequence
tacatctccattag

SEQ ID NO: 2356 - DNA, 14 bp, Artificial sequence
  synthetic sequence
tgcgcaaatttcct

SEQ ID NO: 2357 - DNA, 14 bp, Artificial sequence
  synthetic sequence
acgtagtcatatat

SEQ ID NO: 2358 - DNA, 14 bp, Artificial sequence
  synthetic sequence
gaaatacgtgttct

SEQ ID NO: 2359 - DNA, 14 bp, Artificial sequence
  synthetic sequence
ctcaggtaggtttg

SEQ ID NO: 2360 - DNA, 14 bp, Artificial sequence
  synthetic sequence
gatcgttgcgatgt

SEQ ID NO: 2361 - DNA, 14 bp, Artificial sequence
  synthetic sequence
ggagtttgtataga

SEQ ID NO: 2362 - DNA, 14 bp, Artificial sequence
  synthetic sequence
gattcaacttctag

SEQ ID NO: 2363 - DNA, 14 bp, Artificial sequence
  synthetic sequence
tcatgtatatctga

SEQ ID NO: 2364 - DNA, 14 bp, Artificial sequence
  synthetic sequence
aagctgtcatttta

SEQ ID NO: 2365 - DNA, 14 bp, Artificial sequence
  synthetic sequence
ttccttctccagta

SEQ ID NO: 2366 - DNA, 14 bp, Artificial sequence
  synthetic sequence
atatcacgatttta

SEQ ID NO: 2367 - DNA, 14 bp, Artificial sequence
  synthetic sequence
gatctcattttaag

SEQ ID NO: 2368 - DNA, 14 bp, Artificial sequence
  synthetic sequence
atctatgaattgat

SEQ ID NO: 2369 - DNA, 14 bp, Artificial sequence
  synthetic sequence
tcttgtgtcgcata

SEQ ID NO: 2370 - DNA, 14 bp, Artificial sequence
  synthetic sequence
cgtgttttcagtag

SEQ ID NO: 2371 - DNA, 14 bp, Artificial sequence
  synthetic sequence
cgtttcactcatct

SEQ ID NO: 2372 - DNA, 14 bp, Artificial sequence
  synthetic sequence
ttcatccactcctt

SEQ ID NO: 2373 - DNA, 14 bp, Artificial sequence
  synthetic sequence
ttcttatggtcagc

SEQ ID NO: 2374 - DNA, 14 bp, Artificial sequence
  synthetic sequence
tctatgcgatttaa

SEQ ID NO: 2375 - DNA, 14 bp, Artificial sequence
  synthetic sequence
ttctcatatcccgt

SEQ ID NO: 2376 - DNA, 14 bp, Artificial sequence
  synthetic sequence
tacgtctattataa

SEQ ID NO: 2377 - DNA, 14 bp, Artificial sequence
  synthetic sequence
tgactctctcgttg

SEQ ID NO: 2378 - DNA, 14 bp, Artificial sequence
  synthetic sequence
gtttaacgtatata

SEQ ID NO: 2379 - DNA, 14 bp, Artificial sequence
  synthetic sequence
ttgatatctcgtca

SEQ ID NO: 2380 - DNA, 14 bp, Artificial sequence
  synthetic sequence
taatagtctcctct

SEQ ID NO: 2381 - DNA, 14 bp, Artificial sequence
  synthetic sequence
tgaagtgttcatgt

SEQ ID NO: 2382 - DNA, 14 bp, Artificial sequence
  synthetic sequence
taatttcgtcatag

SEQ ID NO: 2383 - DNA, 14 bp, Artificial sequence
  synthetic sequence
tattaagctttgga

SEQ ID NO: 2384 - DNA, 14 bp, Artificial sequence
  synthetic sequence
cgtgttgatcattc

SEQ ID NO: 2385 - DNA, 14 bp, Artificial sequence
  synthetic sequence
acttagttgttagc

SEQ ID NO: 2386 - DNA, 14 bp, Artificial sequence
  synthetic sequence
ttagtctgggagtt

SEQ ID NO: 2387 - DNA, 14 bp, Artificial sequence
  synthetic sequence
aatattctgttgcg

SEQ ID NO: 2388 - DNA, 14 bp, Artificial sequence
  synthetic sequence
gtcgtcatgttgct

SEQ ID NO: 2389 - DNA, 14 bp, Artificial sequence
  synthetic sequence
tatctagtccttgg

SEQ ID NO: 2390 - DNA, 14 bp, Artificial sequence
  synthetic sequence
agatcattgttgta

SEQ ID NO: 2391 - DNA, 14 bp, Artificial sequence
  synthetic sequence
attttccctcgatc

SEQ ID NO: 2392 - DNA, 14 bp, Artificial sequence
  synthetic sequence
agatttccagattt

SEQ ID NO: 2393 - DNA, 14 bp, Artificial sequence
  synthetic sequence
tcattatactgata

SEQ ID NO: 2394 - DNA, 14 bp, Artificial sequence
  synthetic sequence
tcctctttggggat

SEQ ID NO: 2395 - DNA, 14 bp, Artificial sequence
  synthetic sequence
gacattatctagtt

SEQ ID NO: 2396 - DNA, 14 bp, Artificial sequence
  synthetic sequence
gttccattgaattg

SEQ ID NO: 2397 - DNA, 14 bp, Artificial sequence
  synthetic sequence
gtgatattcacttc

SEQ ID NO: 2398 - DNA, 14 bp, Artificial sequence
  synthetic sequence
gcttatgcttcctg

SEQ ID NO: 2399 - DNA, 14 bp, Artificial sequence
  synthetic sequence
agttcgctttggtg

SEQ ID NO: 2400 - DNA, 14 bp, Artificial sequence
  synthetic sequence
gttgtataaccctt

SEQ ID NO: 2401 - DNA, 14 bp, Artificial sequence
  synthetic sequence
gatttctttccagc

SEQ ID NO: 2402 - DNA, 14 bp, Artificial sequence
  synthetic sequence
cagcttcatcttct

SEQ ID NO: 2403 - DNA, 14 bp, Artificial sequence
  synthetic sequence
ttcgtattgagcct

SEQ ID NO: 2404 - DNA, 14 bp, Artificial sequence
  synthetic sequence
taggtgtttagtga

SEQ ID NO: 2405 - DNA, 14 bp, Artificial sequence
  synthetic sequence
cccatagcttttta

SEQ ID NO: 2406 - DNA, 14 bp, Artificial sequence
  synthetic sequence
aaggggaggcccgg

SEQ ID NO: 2407 - DNA, 14 bp, Artificial sequence
  synthetic sequence
gagcaagggcaccg

SEQ ID NO: 2408 - DNA, 14 bp, Artificial sequence
  synthetic sequence
ggccgacacagcgc

SEQ ID NO: 2409 - DNA, 14 bp, Artificial sequence
  synthetic sequence
caacacgcggaagc

SEQ ID NO: 2410 - DNA, 14 bp, Artificial sequence
  synthetic sequence
gaaacggccgcgga

SEQ ID NO: 2411 - DNA, 14 bp, Artificial sequence
  synthetic sequence
caccagaggacgga

SEQ ID NO: 2412 - DNA, 14 bp, Artificial sequence
  synthetic sequence
aacaacggcgcccg

SEQ ID NO: 2413 - DNA, 14 bp, Artificial sequence
  synthetic sequence
acacccacaccccg

SEQ ID NO: 2414 - DNA, 14 bp, Artificial sequence
  synthetic sequence
cacgaggccaaaac

SEQ ID NO: 2415 - DNA, 14 bp, Artificial sequence
  synthetic sequence
aaaaggcacccaac

SEQ ID NO: 2416 - DNA, 14 bp, Artificial sequence
  synthetic sequence
caacaccgagccga

SEQ ID NO: 2417 - DNA, 14 bp, Artificial sequence
  synthetic sequence
ggcaagacaagaga

SEQ ID NO: 2418 - DNA, 14 bp, Artificial sequence
  synthetic sequence
acgacgacccagcg

SEQ ID NO: 2419 - DNA, 14 bp, Artificial sequence
  synthetic sequence
cacaccgaggccca

SEQ ID NO: 2420 - DNA, 14 bp, Artificial sequence
  synthetic sequence
aaaaggacgagcaa

SEQ ID NO: 2421 - DNA, 14 bp, Artificial sequence
  synthetic sequence
aagcaaaacgaaag

SEQ ID NO: 2422 - DNA, 14 bp, Artificial sequence
  synthetic sequence
agcacgccagacga

SEQ ID NO: 2423 - DNA, 14 bp, Artificial sequence
  synthetic sequence
gaagcacgcagcac

SEQ ID NO: 2424 - DNA, 14 bp, Artificial sequence
  synthetic sequence
ccgcacagcacgcc

SEQ ID NO: 2425 - DNA, 14 bp, Artificial sequence
  synthetic sequence
acgacgacacgagc

SEQ ID NO: 2426 - DNA, 14 bp, Artificial sequence
  synthetic sequence
cggggagcagaaga

SEQ ID NO: 2427 - DNA, 14 bp, Artificial sequence
  synthetic sequence
cccaaagacagcgc

SEQ ID NO: 2428 - DNA, 14 bp, Artificial sequence
  synthetic sequence
ccggagcaccaccg

SEQ ID NO: 2429 - DNA, 14 bp, Artificial sequence
  synthetic sequence
gcccagcaaaagag

SEQ ID NO: 2430 - DNA, 14 bp, Artificial sequence
  synthetic sequence
agcagacgcgacgc

SEQ ID NO: 2431 - DNA, 14 bp, Artificial sequence
  synthetic sequence
agcgaaagacacag

SEQ ID NO: 2432 - DNA, 14 bp, Artificial sequence
  synthetic sequence
acaggaggcggacc

SEQ ID NO: 2433 - DNA, 14 bp, Artificial sequence
  synthetic sequence
agcacgcaagggcg

SEQ ID NO: 2434 - DNA, 14 bp, Artificial sequence
  synthetic sequence
gaaagcccgacgca

SEQ ID NO: 2435 - DNA, 14 bp, Artificial sequence
  synthetic sequence
gaaacgcagaccgg

SEQ ID NO: 2436 - DNA, 14 bp, Artificial sequence
  synthetic sequence
caagccacgcagaa

SEQ ID NO: 2437 - DNA, 14 bp, Artificial sequence
  synthetic sequence
gcgacccggagaaa

SEQ ID NO: 2438 - DNA, 14 bp, Artificial sequence
  synthetic sequence
gcgaaaggcgcgga

SEQ ID NO: 2439 - DNA, 14 bp, Artificial sequence
  synthetic sequence
acacacaacagagc

SEQ ID NO: 2440 - DNA, 14 bp, Artificial sequence
  synthetic sequence
cccagaacaacgcg

SEQ ID NO: 2441 - DNA, 14 bp, Artificial sequence
  synthetic sequence
aaaacgggaacgcc

SEQ ID NO: 2442 - DNA, 14 bp, Artificial sequence
  synthetic sequence
gagaccaacggaaa

SEQ ID NO: 2443 - DNA, 14 bp, Artificial sequence
  synthetic sequence
gagagccacgagca

SEQ ID NO: 2444 - DNA, 14 bp, Artificial sequence
  synthetic sequence
cggaaacgaggaag

SEQ ID NO: 2445 - DNA, 14 bp, Artificial sequence
  synthetic sequence
caagagagggcaag

SEQ ID NO: 2446 - DNA, 14 bp, Artificial sequence
  synthetic sequence
cgacgcgaaagcgg

SEQ ID NO: 2447 - DNA, 14 bp, Artificial sequence
  synthetic sequence
cacggcacgcgaca

SEQ ID NO: 2448 - DNA, 14 bp, Artificial sequence
  synthetic sequence
cagagccgcagcaa

SEQ ID NO: 2449 - DNA, 14 bp, Artificial sequence
  synthetic sequence
accctgcgggacac

SEQ ID NO: 2450 - DNA, 14 bp, Artificial sequence
  synthetic sequence
gaggcaacgcaata

SEQ ID NO: 2451 - DNA, 14 bp, Artificial sequence
  synthetic sequence
agcgtaagcccaac

SEQ ID NO: 2452 - DNA, 14 bp, Artificial sequence
  synthetic sequence
gagaccctagacga

SEQ ID NO: 2453 - DNA, 14 bp, Artificial sequence
  synthetic sequence
gccaacccacacct

SEQ ID NO: 2454 - DNA, 14 bp, Artificial sequence
  synthetic sequence
cgaaccgtcaacag

SEQ ID NO: 2455 - DNA, 14 bp, Artificial sequence
  synthetic sequence
aacgctggcagagg

SEQ ID NO: 2456 - DNA, 14 bp, Artificial sequence
  synthetic sequence
cacagcggtcagaa

SEQ ID NO: 2457 - DNA, 14 bp, Artificial sequence
  synthetic sequence
cactaagcggcgac

SEQ ID NO: 2458 - DNA, 14 bp, Artificial sequence
  synthetic sequence
gcccgtaccgcaca

SEQ ID NO: 2459 - DNA, 14 bp, Artificial sequence
  synthetic sequence
agcccgtgacaaag

SEQ ID NO: 2460 - DNA, 14 bp, Artificial sequence
  synthetic sequence
ctgaaaagagacga

SEQ ID NO: 2461 - DNA, 14 bp, Artificial sequence
  synthetic sequence
gggaaccagctgcc

SEQ ID NO: 2462 - DNA, 14 bp, Artificial sequence
  synthetic sequence
cacctcaccgcgca

SEQ ID NO: 2463 - DNA, 14 bp, Artificial sequence
  synthetic sequence
gcccctccgagaac

SEQ ID NO: 2464 - DNA, 14 bp, Artificial sequence
  synthetic sequence
ccgaaagggcataa

SEQ ID NO: 2465 - DNA, 14 bp, Artificial sequence
  synthetic sequence
gaaatccgacaccg

SEQ ID NO: 2466 - DNA, 14 bp, Artificial sequence
  synthetic sequence
tggaagacgggagc

SEQ ID NO: 2467 - DNA, 14 bp, Artificial sequence
  synthetic sequence
tgggaccacccaaa

SEQ ID NO: 2468 - DNA, 14 bp, Artificial sequence
  synthetic sequence
cgacaatagccaaa

SEQ ID NO: 2469 - DNA, 14 bp, Artificial sequence
  synthetic sequence
gcatggaaggcgcg

SEQ ID NO: 2470 - DNA, 14 bp, Artificial sequence
  synthetic sequence
agagacggatggac

SEQ ID NO: 2471 - DNA, 14 bp, Artificial sequence
  synthetic sequence
cataaggcggagcg

SEQ ID NO: 2472 - DNA, 14 bp, Artificial sequence
  synthetic sequence
agaggccgtgggga

SEQ ID NO: 2473 - DNA, 14 bp, Artificial sequence
  synthetic sequence
tgggaccgggacgc

SEQ ID NO: 2474 - DNA, 14 bp, Artificial sequence
  synthetic sequence
caaaaggcctccca

SEQ ID NO: 2475 - DNA, 14 bp, Artificial sequence
  synthetic sequence
tgggacacaacgga

SEQ ID NO: 2476 - DNA, 14 bp, Artificial sequence
  synthetic sequence
aacacggtcccacc

SEQ ID NO: 2477 - DNA, 14 bp, Artificial sequence
  synthetic sequence
gacgctcaacaaag

SEQ ID NO: 2478 - DNA, 14 bp, Artificial sequence
  synthetic sequence
cacatgggagccac

SEQ ID NO: 2479 - DNA, 14 bp, Artificial sequence
  synthetic sequence
cgagaaacatacaa

SEQ ID NO: 2480 - DNA, 14 bp, Artificial sequence
  synthetic sequence
agacacgtaccacc

SEQ ID NO: 2481 - DNA, 14 bp, Artificial sequence
  synthetic sequence
aagcgcgaacctca

SEQ ID NO: 2482 - DNA, 14 bp, Artificial sequence
  synthetic sequence
agcccagcctgcaa

SEQ ID NO: 2483 - DNA, 14 bp, Artificial sequence
  synthetic sequence
gtggcaccaggaac

SEQ ID NO: 2484 - DNA, 14 bp, Artificial sequence
  synthetic sequence
agcctaggagcggg

SEQ ID NO: 2485 - DNA, 14 bp, Artificial sequence
  synthetic sequence
cagacgcccatccc

SEQ ID NO: 2486 - DNA, 14 bp, Artificial sequence
  synthetic sequence
agaaagtcacaacg

SEQ ID NO: 2487 - DNA, 14 bp, Artificial sequence
  synthetic sequence
aggcagtcccgaga

SEQ ID NO: 2488 - DNA, 14 bp, Artificial sequence
  synthetic sequence
cggtcacgacacca

SEQ ID NO: 2489 - DNA, 14 bp, Artificial sequence
  synthetic sequence
gtaaccacaacagc

SEQ ID NO: 2490 - DNA, 14 bp, Artificial sequence
  synthetic sequence
aactggacccacag

SEQ ID NO: 2491 - DNA, 14 bp, Artificial sequence
  synthetic sequence
ctcaaagcgcgaaa

SEQ ID NO: 2492 - DNA, 14 bp, Artificial sequence
  synthetic sequence
acgagagacaaatc

SEQ ID NO: 2493 - DNA, 14 bp, Artificial sequence
  synthetic sequence
ggtcccccaagaag

SEQ ID NO: 2494 - DNA, 14 bp, Artificial sequence
  synthetic sequence
gtaggaaagacagg

SEQ ID NO: 2495 - DNA, 14 bp, Artificial sequence
  synthetic sequence
gtgacggcaagccc

SEQ ID NO: 2496 - DNA, 14 bp, Artificial sequence
  synthetic sequence
aaccgagccccaat

SEQ ID NO: 2497 - DNA, 14 bp, Artificial sequence
  synthetic sequence
gacggaccgaggta

SEQ ID NO: 2498 - DNA, 14 bp, Artificial sequence
  synthetic sequence
aaaaggatgacagc

SEQ ID NO: 2499 - DNA, 14 bp, Artificial sequence
  synthetic sequence
agaagatgcacagc

SEQ ID NO: 2500 - DNA, 14 bp, Artificial sequence
  synthetic sequence
cgagaagcgccgat

SEQ ID NO: 2501 - DNA, 14 bp, Artificial sequence
  synthetic sequence
gcacgcactgccga

SEQ ID NO: 2502 - DNA, 14 bp, Artificial sequence
  synthetic sequence
atgccccaaacccg

SEQ ID NO: 2503 - DNA, 14 bp, Artificial sequence
  synthetic sequence
aaaacgccacgata

SEQ ID NO: 2504 - DNA, 14 bp, Artificial sequence
  synthetic sequence
ccggataaggggcc

SEQ ID NO: 2505 - DNA, 14 bp, Artificial sequence
  synthetic sequence
gacaagtcggacgc

SEQ ID NO: 2506 - DNA, 14 bp, Artificial sequence
  synthetic sequence
ataaacgcaccagg

SEQ ID NO: 2507 - DNA, 14 bp, Artificial sequence
  synthetic sequence
aagtcagaccgccc

SEQ ID NO: 2508 - DNA, 14 bp, Artificial sequence
  synthetic sequence
ggcgtgcaacggag

SEQ ID NO: 2509 - DNA, 14 bp, Artificial sequence
  synthetic sequence
gagagaccccaatc

SEQ ID NO: 2510 - DNA, 14 bp, Artificial sequence
  synthetic sequence
cccagcctcagggc

SEQ ID NO: 2511 - DNA, 14 bp, Artificial sequence
  synthetic sequence
gggaaatccagcag

SEQ ID NO: 2512 - DNA, 14 bp, Artificial sequence
  synthetic sequence
aaacacaggcagct

SEQ ID NO: 2513 - DNA, 14 bp, Artificial sequence
  synthetic sequence
ccacggtaccaagg

SEQ ID NO: 2514 - DNA, 14 bp, Artificial sequence
  synthetic sequence
cagtgcgggacgcg

SEQ ID NO: 2515 - DNA, 14 bp, Artificial sequence
  synthetic sequence
cgagcgtaaggcga

SEQ ID NO: 2516 - DNA, 14 bp, Artificial sequence
  synthetic sequence
ggaaccctaaggga

SEQ ID NO: 2517 - DNA, 14 bp, Artificial sequence
  synthetic sequence
gggatgaacaagag

SEQ ID NO: 2518 - DNA, 14 bp, Artificial sequence
  synthetic sequence
gcggtgcgcaaggg

SEQ ID NO: 2519 - DNA, 14 bp, Artificial sequence
  synthetic sequence
caaaccaactggcg

SEQ ID NO: 2520 - DNA, 14 bp, Artificial sequence
  synthetic sequence
gccgaaggaacgtg

SEQ ID NO: 2521 - DNA, 14 bp, Artificial sequence
  synthetic sequence
gcacgaagacccta

SEQ ID NO: 2522 - DNA, 14 bp, Artificial sequence
  synthetic sequence
gagcctagcgccgg

SEQ ID NO: 2523 - DNA, 14 bp, Artificial sequence
  synthetic sequence
tacaagcacaccgc

SEQ ID NO: 2524 - DNA, 14 bp, Artificial sequence
  synthetic sequence
gccgcaaataccac

SEQ ID NO: 2525 - DNA, 14 bp, Artificial sequence
  synthetic sequence
cactcacagccagc

SEQ ID NO: 2526 - DNA, 14 bp, Artificial sequence
  synthetic sequence
cagaaccctcgccg

SEQ ID NO: 2527 - DNA, 14 bp, Artificial sequence
  synthetic sequence
aaccacccctagac

SEQ ID NO: 2528 - DNA, 14 bp, Artificial sequence
  synthetic sequence
gatcgccaaaccgg

SEQ ID NO: 2529 - DNA, 14 bp, Artificial sequence
  synthetic sequence
taaccagaaacacc

SEQ ID NO: 2530 - DNA, 14 bp, Artificial sequence
  synthetic sequence
cacctaggccggac

SEQ ID NO: 2531 - DNA, 14 bp, Artificial sequence
  synthetic sequence
acgcaaatgcagcc

SEQ ID NO: 2532 - DNA, 14 bp, Artificial sequence
  synthetic sequence
aagcggaccgctga

SEQ ID NO: 2533 - DNA, 14 bp, Artificial sequence
  synthetic sequence
tgccaagggccggc

SEQ ID NO: 2534 - DNA, 14 bp, Artificial sequence
  synthetic sequence
cccgagtagcgcgg

SEQ ID NO: 2535 - DNA, 14 bp, Artificial sequence
  synthetic sequence
gtcccagacgcccc

SEQ ID NO: 2536 - DNA, 14 bp, Artificial sequence
  synthetic sequence
aaacgcgcgcggtg

SEQ ID NO: 2537 - DNA, 14 bp, Artificial sequence
  synthetic sequence
gggaagcaggcatc

SEQ ID NO: 2538 - DNA, 14 bp, Artificial sequence
  synthetic sequence
acgaaagcatgcac

SEQ ID NO: 2539 - DNA, 14 bp, Artificial sequence
  synthetic sequence
acgcagtggaagag

SEQ ID NO: 2540 - DNA, 14 bp, Artificial sequence
  synthetic sequence
aatacgaaaacacg

SEQ ID NO: 2541 - DNA, 14 bp, Artificial sequence
  synthetic sequence
cgcggagagagcct

SEQ ID NO: 2542 - DNA, 14 bp, Artificial sequence
  synthetic sequence
cataagcgcacacc

SEQ ID NO: 2543 - DNA, 14 bp, Artificial sequence
  synthetic sequence
ggcaaaagtaagca

SEQ ID NO: 2544 - DNA, 14 bp, Artificial sequence
  synthetic sequence
cagagtggcgcccc

SEQ ID NO: 2545 - DNA, 14 bp, Artificial sequence
  synthetic sequence
gcaccctcagaccc

SEQ ID NO: 2546 - DNA, 14 bp, Artificial sequence
  synthetic sequence
gaaaaccgcgacat

SEQ ID NO: 2547 - DNA, 14 bp, Artificial sequence
  synthetic sequence
aaaagtggcgcaag

SEQ ID NO: 2548 - DNA, 14 bp, Artificial sequence
  synthetic sequence
cacaaagagccgtg

SEQ ID NO: 2549 - DNA, 14 bp, Artificial sequence
  synthetic sequence
aacctacaagcgca

SEQ ID NO: 2550 - DNA, 14 bp, Artificial sequence
  synthetic sequence
cagataagcccgcc

SEQ ID NO: 2551 - DNA, 14 bp, Artificial sequence
  synthetic sequence
caaaaaccacatcg

SEQ ID NO: 2552 - DNA, 14 bp, Artificial sequence
  synthetic sequence
caaccccaccccct

SEQ ID NO: 2553 - DNA, 14 bp, Artificial sequence
  synthetic sequence
ccgcgacctaacac

SEQ ID NO: 2554 - DNA, 14 bp, Artificial sequence
  synthetic sequence
agcgagaaatcgac

SEQ ID NO: 2555 - DNA, 14 bp, Artificial sequence
  synthetic sequence
acaagacaataacg

SEQ ID NO: 2556 - DNA, 14 bp, Artificial sequence
  synthetic sequence
gactacacgaccga

SEQ ID NO: 2557 - DNA, 14 bp, Artificial sequence
  synthetic sequence
aacaacgcgactaa

SEQ ID NO: 2558 - DNA, 14 bp, Artificial sequence
  synthetic sequence
cgcgtagggcagag

SEQ ID NO: 2559 - DNA, 14 bp, Artificial sequence
  synthetic sequence
aaacgggaatgaag

SEQ ID NO: 2560 - DNA, 14 bp, Artificial sequence
  synthetic sequence
ggccagcaacgtgc

SEQ ID NO: 2561 - DNA, 14 bp, Artificial sequence
  synthetic sequence
gaaccgaagggaat

SEQ ID NO: 2562 - DNA, 14 bp, Artificial sequence
  synthetic sequence
ataaaaagcaaccc

SEQ ID NO: 2563 - DNA, 14 bp, Artificial sequence
  synthetic sequence
cggagcacgataac

SEQ ID NO: 2564 - DNA, 14 bp, Artificial sequence
  synthetic sequence
caacagtgcccaga

SEQ ID NO: 2565 - DNA, 14 bp, Artificial sequence
  synthetic sequence
ccaggccacgtcgg

SEQ ID NO: 2566 - DNA, 14 bp, Artificial sequence
  synthetic sequence
cgcgtgcccagagg

SEQ ID NO: 2567 - DNA, 14 bp, Artificial sequence
  synthetic sequence
caccgcacacatgg

SEQ ID NO: 2568 - DNA, 14 bp, Artificial sequence
  synthetic sequence
gaggtcaagcaggg

SEQ ID NO: 2569 - DNA, 14 bp, Artificial sequence
  synthetic sequence
accccgactgccgg

SEQ ID NO: 2570 - DNA, 14 bp, Artificial sequence
  synthetic sequence
cacctgcacacgac

SEQ ID NO: 2571 - DNA, 14 bp, Artificial sequence
  synthetic sequence
gagaaaaagaaatc

SEQ ID NO: 2572 - DNA, 14 bp, Artificial sequence
  synthetic sequence
aagcgcaacccgtg

SEQ ID NO: 2573 - DNA, 14 bp, Artificial sequence
  synthetic sequence
aagagatagacgac

SEQ ID NO: 2574 - DNA, 14 bp, Artificial sequence
  synthetic sequence
gcatcgaaccgcga

SEQ ID NO: 2575 - DNA, 14 bp, Artificial sequence
  synthetic sequence
catggacaaagacg

SEQ ID NO: 2576 - DNA, 14 bp, Artificial sequence
  synthetic sequence
cgaatagaaacgga

SEQ ID NO: 2577 - DNA, 14 bp, Artificial sequence
  synthetic sequence
tcagaaagggcacc

SEQ ID NO: 2578 - DNA, 14 bp, Artificial sequence
  synthetic sequence
gtgtgcacccgggc

SEQ ID NO: 2579 - DNA, 14 bp, Artificial sequence
  synthetic sequence
cgctcgcgagatgg

SEQ ID NO: 2580 - DNA, 14 bp, Artificial sequence
  synthetic sequence
gagaagttacaaag

SEQ ID NO: 2581 - DNA, 14 bp, Artificial sequence
  synthetic sequence
gaagtcacaagcgt

SEQ ID NO: 2582 - DNA, 14 bp, Artificial sequence
  synthetic sequence
gcatagagcaggtc

SEQ ID NO: 2583 - DNA, 14 bp, Artificial sequence
  synthetic sequence
agttcgcgggccca

SEQ ID NO: 2584 - DNA, 14 bp, Artificial sequence
  synthetic sequence
agtcacaaactcaa

SEQ ID NO: 2585 - DNA, 14 bp, Artificial sequence
  synthetic sequence
gaggagcgtacgtc

SEQ ID NO: 2586 - DNA, 14 bp, Artificial sequence
  synthetic sequence
tcggagcggctggc

SEQ ID NO: 2587 - DNA, 14 bp, Artificial sequence
  synthetic sequence
cgcgatacgcctga

SEQ ID NO: 2588 - DNA, 14 bp, Artificial sequence
  synthetic sequence
caacgggctagtca

SEQ ID NO: 2589 - DNA, 14 bp, Artificial sequence
  synthetic sequence
cctccatcgaagcc

SEQ ID NO: 2590 - DNA, 14 bp, Artificial sequence
  synthetic sequence
taaggtgaaaagga

SEQ ID NO: 2591 - DNA, 14 bp, Artificial sequence
  synthetic sequence
cctacctaacccca

SEQ ID NO: 2592 - DNA, 14 bp, Artificial sequence
  synthetic sequence
ctcgtcgaaacaag

SEQ ID NO: 2593 - DNA, 14 bp, Artificial sequence
  synthetic sequence
aggataaaccgata

SEQ ID NO: 2594 - DNA, 14 bp, Artificial sequence
  synthetic sequence
gacacagtatacgg

SEQ ID NO: 2595 - DNA, 14 bp, Artificial sequence
  synthetic sequence
actgaccagctaca

SEQ ID NO: 2596 - DNA, 14 bp, Artificial sequence
  synthetic sequence
tcatacgacgaaag

SEQ ID NO: 2597 - DNA, 14 bp, Artificial sequence
  synthetic sequence
acgcgacgttgagg

SEQ ID NO: 2598 - DNA, 14 bp, Artificial sequence
  synthetic sequence
cagataaaaatcga

SEQ ID NO: 2599 - DNA, 14 bp, Artificial sequence
  synthetic sequence
ggtgtgaaaggcac

SEQ ID NO: 2600 - DNA, 14 bp, Artificial sequence
  synthetic sequence
agatacgccagagt

SEQ ID NO: 2601 - DNA, 14 bp, Artificial sequence
  synthetic sequence
aaggtcccgcatcg

SEQ ID NO: 2602 - DNA, 14 bp, Artificial sequence
  synthetic sequence
agtacataggcggg

SEQ ID NO: 2603 - DNA, 14 bp, Artificial sequence
  synthetic sequence
ccgcgtgaacgaat

SEQ ID NO: 2604 - DNA, 14 bp, Artificial sequence
  synthetic sequence
ctcgagggtcggca

SEQ ID NO: 2605 - DNA, 14 bp, Artificial sequence
  synthetic sequence
tgaacacataccga

SEQ ID NO: 2606 - DNA, 14 bp, Artificial sequence
  synthetic sequence
gactgagctcgcac

SEQ ID NO: 2607 - DNA, 14 bp, Artificial sequence
  synthetic sequence
actggaagacggta

SEQ ID NO: 2608 - DNA, 14 bp, Artificial sequence
  synthetic sequence
aagccgctaccctg

SEQ ID NO: 2609 - DNA, 14 bp, Artificial sequence
  synthetic sequence
gcgacgctagggtg

SEQ ID NO: 2610 - DNA, 14 bp, Artificial sequence
  synthetic sequence
acctcctaggaggc

SEQ ID NO: 2611 - DNA, 14 bp, Artificial sequence
  synthetic sequence
tctgggggagggag

SEQ ID NO: 2612 - DNA, 14 bp, Artificial sequence
  synthetic sequence
gccgatgacatgca

SEQ ID NO: 2613 - DNA, 14 bp, Artificial sequence
  synthetic sequence
ctccacacggacta

SEQ ID NO: 2614 - DNA, 14 bp, Artificial sequence
  synthetic sequence
ataaccggggggct

SEQ ID NO: 2615 - DNA, 14 bp, Artificial sequence
  synthetic sequence
acaagtaaagtagc

SEQ ID NO: 2616 - DNA, 14 bp, Artificial sequence
  synthetic sequence
acccggatatcgaa

SEQ ID NO: 2617 - DNA, 14 bp, Artificial sequence
  synthetic sequence
catgcctggaggcg

SEQ ID NO: 2618 - DNA, 14 bp, Artificial sequence
  synthetic sequence
ataagtcgacgacg

SEQ ID NO: 2619 - DNA, 14 bp, Artificial sequence
  synthetic sequence
agcctgcggtgggg

SEQ ID NO: 2620 - DNA, 14 bp, Artificial sequence
  synthetic sequence
gcgtgcgcaataga

SEQ ID NO: 2621 - DNA, 14 bp, Artificial sequence
  synthetic sequence
gcgctcgcactccc

SEQ ID NO: 2622 - DNA, 14 bp, Artificial sequence
  synthetic sequence
actcacccgtggag

SEQ ID NO: 2623 - DNA, 14 bp, Artificial sequence
  synthetic sequence
accactccaagtca

SEQ ID NO: 2624 - DNA, 14 bp, Artificial sequence
  synthetic sequence
gtaaaatcacaagc

SEQ ID NO: 2625 - DNA, 14 bp, Artificial sequence
  synthetic sequence
ggaaacataactcc

SEQ ID NO: 2626 - DNA, 14 bp, Artificial sequence
  synthetic sequence
gtgcggcacaagat

SEQ ID NO: 2627 - DNA, 14 bp, Artificial sequence
  synthetic sequence
aacgtataaagaac

SEQ ID NO: 2628 - DNA, 14 bp, Artificial sequence
  synthetic sequence
ggaaggaaccctgt

SEQ ID NO: 2629 - DNA, 14 bp, Artificial sequence
  synthetic sequence
taagacgggtacga

SEQ ID NO: 2630 - DNA, 14 bp, Artificial sequence
  synthetic sequence
ccgcacctgcgtcg

SEQ ID NO: 2631 - DNA, 14 bp, Artificial sequence
  synthetic sequence
tacccctgcaccag

SEQ ID NO: 2632 - DNA, 14 bp, Artificial sequence
  synthetic sequence
gtcacgaaccgcct

SEQ ID NO: 2633 - DNA, 14 bp, Artificial sequence
  synthetic sequence
ccgccactccagtg

SEQ ID NO: 2634 - DNA, 14 bp, Artificial sequence
  synthetic sequence
ctgcaaggtcgcac

SEQ ID NO: 2635 - DNA, 14 bp, Artificial sequence
  synthetic sequence
cctcacggcctggc

SEQ ID NO: 2636 - DNA, 14 bp, Artificial sequence
  synthetic sequence
taaccaataggagg

SEQ ID NO: 2637 - DNA, 14 bp, Artificial sequence
  synthetic sequence
gcaggagagtacat

SEQ ID NO: 2638 - DNA, 14 bp, Artificial sequence
  synthetic sequence
gacgagaaaacctt

SEQ ID NO: 2639 - DNA, 14 bp, Artificial sequence
  synthetic sequence
agagccaccaagtt

SEQ ID NO: 2640 - DNA, 14 bp, Artificial sequence
  synthetic sequence
actaagacgcaatc

SEQ ID NO: 2641 - DNA, 14 bp, Artificial sequence
  synthetic sequence
cgtggaggcccata

SEQ ID NO: 2642 - DNA, 14 bp, Artificial sequence
  synthetic sequence
cggggttaggcggc

SEQ ID NO: 2643 - DNA, 14 bp, Artificial sequence
  synthetic sequence
cacgaagtcacgtc

SEQ ID NO: 2644 - DNA, 14 bp, Artificial sequence
  synthetic sequence
ggcctgtacgggac

SEQ ID NO: 2645 - DNA, 14 bp, Artificial sequence
  synthetic sequence
caattgacgcacac

SEQ ID NO: 2646 - DNA, 14 bp, Artificial sequence
  synthetic sequence
ctcacggctcaccc

SEQ ID NO: 2647 - DNA, 14 bp, Artificial sequence
  synthetic sequence
acaaggggagtgta

SEQ ID NO: 2648 - DNA, 14 bp, Artificial sequence
  synthetic sequence
atggtcaccccaag

SEQ ID NO: 2649 - DNA, 14 bp, Artificial sequence
  synthetic sequence
ctagccctccgacc

SEQ ID NO: 2650 - DNA, 14 bp, Artificial sequence
  synthetic sequence
acactatacaccac

SEQ ID NO: 2651 - DNA, 14 bp, Artificial sequence
  synthetic sequence
ataagccatgcggg

SEQ ID NO: 2652 - DNA, 14 bp, Artificial sequence
  synthetic sequence
tgtagacaagaagg

SEQ ID NO: 2653 - DNA, 14 bp, Artificial sequence
  synthetic sequence
cccacaccgcttaa

SEQ ID NO: 2654 - DNA, 14 bp, Artificial sequence
  synthetic sequence
aaccatccaacgtc

SEQ ID NO: 2655 - DNA, 14 bp, Artificial sequence
  synthetic sequence
catgagtgaaaaca

SEQ ID NO: 2656 - DNA, 14 bp, Artificial sequence
  synthetic sequence
aggctccgtcagac

SEQ ID NO: 2657 - DNA, 14 bp, Artificial sequence
  synthetic sequence
aacgcctaactcgg

SEQ ID NO: 2658 - DNA, 14 bp, Artificial sequence
  synthetic sequence
aatcagtacgggag

SEQ ID NO: 2659 - DNA, 14 bp, Artificial sequence
  synthetic sequence
cacctaaacggcgt

SEQ ID NO: 2660 - DNA, 14 bp, Artificial sequence
  synthetic sequence
ccatagaaactaag

SEQ ID NO: 2661 - DNA, 14 bp, Artificial sequence
  synthetic sequence
gtcagtgcacaacg

SEQ ID NO: 2662 - DNA, 14 bp, Artificial sequence
  synthetic sequence
tggaccggtgagcc

SEQ ID NO: 2663 - DNA, 14 bp, Artificial sequence
  synthetic sequence
gatggcgctagcag

SEQ ID NO: 2664 - DNA, 14 bp, Artificial sequence
  synthetic sequence
tatcagagcaccac

SEQ ID NO: 2665 - DNA, 14 bp, Artificial sequence
  synthetic sequence
cactccagctcgaa

SEQ ID NO: 2666 - DNA, 14 bp, Artificial sequence
  synthetic sequence
cagaggcacaattc

SEQ ID NO: 2667 - DNA, 14 bp, Artificial sequence
  synthetic sequence
gggtagctgcgcac

SEQ ID NO: 2668 - DNA, 14 bp, Artificial sequence
  synthetic sequence
cgatcgcaggtaag

SEQ ID NO: 2669 - DNA, 14 bp, Artificial sequence
  synthetic sequence
ccacgcttacgccg

SEQ ID NO: 2670 - DNA, 14 bp, Artificial sequence
  synthetic sequence
gaaccctccatacc

SEQ ID NO: 2671 - DNA, 14 bp, Artificial sequence
  synthetic sequence
aaacatgcgagggt

SEQ ID NO: 2672 - DNA, 14 bp, Artificial sequence
  synthetic sequence
gtgcgtgggagaga

SEQ ID NO: 2673 - DNA, 14 bp, Artificial sequence
  synthetic sequence
tacagaggcctaaa

SEQ ID NO: 2674 - DNA, 14 bp, Artificial sequence
  synthetic sequence
gcggcaaagcttgg

SEQ ID NO: 2675 - DNA, 14 bp, Artificial sequence
  synthetic sequence
tggacatcgcgaaa

SEQ ID NO: 2676 - DNA, 14 bp, Artificial sequence
  synthetic sequence
aagattggacgaac

SEQ ID NO: 2677 - DNA, 14 bp, Artificial sequence
  synthetic sequence
aagactaagaagta

SEQ ID NO: 2678 - DNA, 14 bp, Artificial sequence
  synthetic sequence
tggagagagcatag

SEQ ID NO: 2679 - DNA, 14 bp, Artificial sequence
  synthetic sequence
ctgggtaaaaggga

SEQ ID NO: 2680 - DNA, 14 bp, Artificial sequence
  synthetic sequence
gactaccgaggggt

SEQ ID NO: 2681 - DNA, 14 bp, Artificial sequence
  synthetic sequence
cccagcacgcactt

SEQ ID NO: 2682 - DNA, 14 bp, Artificial sequence
  synthetic sequence
gaatgggaccgtgc

SEQ ID NO: 2683 - DNA, 14 bp, Artificial sequence
  synthetic sequence
catcgaaagataaa

SEQ ID NO: 2684 - DNA, 14 bp, Artificial sequence
  synthetic sequence
agtaggctagagag

SEQ ID NO: 2685 - DNA, 14 bp, Artificial sequence
  synthetic sequence
cgagtatacacaca

SEQ ID NO: 2686 - DNA, 14 bp, Artificial sequence
  synthetic sequence
aggattgagaccga

SEQ ID NO: 2687 - DNA, 14 bp, Artificial sequence
  synthetic sequence
ctcacagcggccat

SEQ ID NO: 2688 - DNA, 14 bp, Artificial sequence
  synthetic sequence
tctgaacggcaacg

SEQ ID NO: 2689 - DNA, 14 bp, Artificial sequence
  synthetic sequence
aatcgggactcaga

SEQ ID NO: 2690 - DNA, 14 bp, Artificial sequence
  synthetic sequence
gaaagtgggtggcc

SEQ ID NO: 2691 - DNA, 14 bp, Artificial sequence
  synthetic sequence
cactcgacgcgtag

SEQ ID NO: 2692 - DNA, 14 bp, Artificial sequence
  synthetic sequence
gcctatggggcggg

SEQ ID NO: 2693 - DNA, 14 bp, Artificial sequence
  synthetic sequence
cctaactacggagg

SEQ ID NO: 2694 - DNA, 14 bp, Artificial sequence
  synthetic sequence
aagtctcccgcacg

SEQ ID NO: 2695 - DNA, 14 bp, Artificial sequence
  synthetic sequence
tcggccaccaatag

SEQ ID NO: 2696 - DNA, 14 bp, Artificial sequence
  synthetic sequence
gagagctggctgga

SEQ ID NO: 2697 - DNA, 14 bp, Artificial sequence
  synthetic sequence
aatgcgacgcacat

SEQ ID NO: 2698 - DNA, 14 bp, Artificial sequence
  synthetic sequence
gcccacacgtgtcc

SEQ ID NO: 2699 - DNA, 14 bp, Artificial sequence
  synthetic sequence
gataaaaataccag

SEQ ID NO: 2700 - DNA, 14 bp, Artificial sequence
  synthetic sequence
gtcacgctgggaga

SEQ ID NO: 2701 - DNA, 14 bp, Artificial sequence
  synthetic sequence
aggcagtataagca

SEQ ID NO: 2702 - DNA, 14 bp, Artificial sequence
  synthetic sequence
tacaacatcgaacc

SEQ ID NO: 2703 - DNA, 14 bp, Artificial sequence
  synthetic sequence
ccgaagggtataac

SEQ ID NO: 2704 - DNA, 14 bp, Artificial sequence
  synthetic sequence
gttgagggccgcag

SEQ ID NO: 2705 - DNA, 14 bp, Artificial sequence
  synthetic sequence
gccaactgcaaaat

SEQ ID NO: 2706 - DNA, 14 bp, Artificial sequence
  synthetic sequence
cggcaatccgtaac

SEQ ID NO: 2707 - DNA, 14 bp, Artificial sequence
  synthetic sequence
ccgggtctaccgca

SEQ ID NO: 2708 - DNA, 14 bp, Artificial sequence
  synthetic sequence
gctgagtcgggccc

SEQ ID NO: 2709 - DNA, 14 bp, Artificial sequence
  synthetic sequence
ggctagatagaggc

SEQ ID NO: 2710 - DNA, 14 bp, Artificial sequence
  synthetic sequence
gaagcagtgtcaaa

SEQ ID NO: 2711 - DNA, 14 bp, Artificial sequence
  synthetic sequence
aaagtgccatacgc

SEQ ID NO: 2712 - DNA, 14 bp, Artificial sequence
  synthetic sequence
tcgatggcgaaacc

SEQ ID NO: 2713 - DNA, 14 bp, Artificial sequence
  synthetic sequence
ccccgactgctggc

SEQ ID NO: 2714 - DNA, 14 bp, Artificial sequence
  synthetic sequence
aatggcacaggtcg

SEQ ID NO: 2715 - DNA, 14 bp, Artificial sequence
  synthetic sequence
tccgaagcgtgaca

SEQ ID NO: 2716 - DNA, 14 bp, Artificial sequence
  synthetic sequence
gatatgaacacaga

SEQ ID NO: 2717 - DNA, 14 bp, Artificial sequence
  synthetic sequence
ccgagctcggcagt

SEQ ID NO: 2718 - DNA, 14 bp, Artificial sequence
  synthetic sequence
gacggtagaagtca

SEQ ID NO: 2719 - DNA, 14 bp, Artificial sequence
  synthetic sequence
aaacttaagaccca

SEQ ID NO: 2720 - DNA, 14 bp, Artificial sequence
  synthetic sequence
gacccggagactat

SEQ ID NO: 2721 - DNA, 14 bp, Artificial sequence
  synthetic sequence
cgcacgaccattag

SEQ ID NO: 2722 - DNA, 14 bp, Artificial sequence
  synthetic sequence
caaaatcatcaaga

SEQ ID NO: 2723 - DNA, 14 bp, Artificial sequence
  synthetic sequence
ggtctacgagcaaa

SEQ ID NO: 2724 - DNA, 14 bp, Artificial sequence
  synthetic sequence
tcaccgcagagata

SEQ ID NO: 2725 - DNA, 14 bp, Artificial sequence
  synthetic sequence
tggcgagcggcata

SEQ ID NO: 2726 - DNA, 14 bp, Artificial sequence
  synthetic sequence
gttgccaaacagaa

SEQ ID NO: 2727 - DNA, 14 bp, Artificial sequence
  synthetic sequence
ctggtaggggccac

SEQ ID NO: 2728 - DNA, 14 bp, Artificial sequence
  synthetic sequence
gaaatcgactacag

SEQ ID NO: 2729 - DNA, 14 bp, Artificial sequence
  synthetic sequence
tgacctcaggggag

SEQ ID NO: 2730 - DNA, 14 bp, Artificial sequence
  synthetic sequence
acacgtgtcggggg

SEQ ID NO: 2731 - DNA, 14 bp, Artificial sequence
  synthetic sequence
cctcgagcatgaca

SEQ ID NO: 2732 - DNA, 14 bp, Artificial sequence
  synthetic sequence
cccgcttagggaag

SEQ ID NO: 2733 - DNA, 14 bp, Artificial sequence
  synthetic sequence
tgtgagccgacacc

SEQ ID NO: 2734 - DNA, 14 bp, Artificial sequence
  synthetic sequence
ggcggttgggagcc

SEQ ID NO: 2735 - DNA, 14 bp, Artificial sequence
  synthetic sequence
ggaatcgaaaccat

SEQ ID NO: 2736 - DNA, 14 bp, Artificial sequence
  synthetic sequence
acactagacgatca

SEQ ID NO: 2737 - DNA, 14 bp, Artificial sequence
  synthetic sequence
gactgagcgcatcg

SEQ ID NO: 2738 - DNA, 14 bp, Artificial sequence
  synthetic sequence
ataaggggatgccc

SEQ ID NO: 2739 - DNA, 14 bp, Artificial sequence
  synthetic sequence
tcaccaaccggctg

SEQ ID NO: 2740 - DNA, 14 bp, Artificial sequence
  synthetic sequence
ggttcggcacggac

SEQ ID NO: 2741 - DNA, 14 bp, Artificial sequence
  synthetic sequence
aaacatggatcagc

SEQ ID NO: 2742 - DNA, 14 bp, Artificial sequence
  synthetic sequence
agcaagtactccag

SEQ ID NO: 2743 - DNA, 14 bp, Artificial sequence
  synthetic sequence
atcaagtcccgcgc

SEQ ID NO: 2744 - DNA, 14 bp, Artificial sequence
  synthetic sequence
gacgctggaacctc

SEQ ID NO: 2745 - DNA, 14 bp, Artificial sequence
  synthetic sequence
aaaagcgcagatct

SEQ ID NO: 2746 - DNA, 14 bp, Artificial sequence
  synthetic sequence
aaagtcaactaaca

SEQ ID NO: 2747 - DNA, 14 bp, Artificial sequence
  synthetic sequence
ctaactaacccccg

SEQ ID NO: 2748 - DNA, 14 bp, Artificial sequence
  synthetic sequence
taagccgtgacccc

SEQ ID NO: 2749 - DNA, 14 bp, Artificial sequence
  synthetic sequence
atggccctgggcga

SEQ ID NO: 2750 - DNA, 14 bp, Artificial sequence
  synthetic sequence
atgagggcctcaag

SEQ ID NO: 2751 - DNA, 14 bp, Artificial sequence
  synthetic sequence
gggaggtcctaaga

SEQ ID NO: 2752 - DNA, 14 bp, Artificial sequence
  synthetic sequence
ttggcacagaccgc

SEQ ID NO: 2753 - DNA, 14 bp, Artificial sequence
  synthetic sequence
cacttgacaaccgc

SEQ ID NO: 2754 - DNA, 14 bp, Artificial sequence
  synthetic sequence
aacatacgcagcgt

SEQ ID NO: 2755 - DNA, 14 bp, Artificial sequence
  synthetic sequence
cacacaggcaggtt

SEQ ID NO: 2756 - DNA, 14 bp, Artificial sequence
  synthetic sequence
caccccacgactta

SEQ ID NO: 2757 - DNA, 14 bp, Artificial sequence
  synthetic sequence
gggcactgtcacag

SEQ ID NO: 2758 - DNA, 14 bp, Artificial sequence
  synthetic sequence
ctatagcaacagga

SEQ ID NO: 2759 - DNA, 14 bp, Artificial sequence
  synthetic sequence
ctataagcgcaccc

SEQ ID NO: 2760 - DNA, 14 bp, Artificial sequence
  synthetic sequence
aacgagcatagagt

SEQ ID NO: 2761 - DNA, 14 bp, Artificial sequence
  synthetic sequence
agtgcagcgtacca

SEQ ID NO: 2762 - DNA, 14 bp, Artificial sequence
  synthetic sequence
ctaaggagcgtacg

SEQ ID NO: 2763 - DNA, 14 bp, Artificial sequence
  synthetic sequence
cgttccgagccgaa

SEQ ID NO: 2764 - DNA, 14 bp, Artificial sequence
  synthetic sequence
ggataaatacgcaa

SEQ ID NO: 2765 - DNA, 14 bp, Artificial sequence
  synthetic sequence
cgtcccgagtaacg

SEQ ID NO: 2766 - DNA, 14 bp, Artificial sequence
  synthetic sequence
taacgtcccggaca

SEQ ID NO: 2767 - DNA, 14 bp, Artificial sequence
  synthetic sequence
ctacccgacctgaa

SEQ ID NO: 2768 - DNA, 14 bp, Artificial sequence
  synthetic sequence
gatagataaaacaa

SEQ ID NO: 2769 - DNA, 14 bp, Artificial sequence
  synthetic sequence
ataccgactgacaa

SEQ ID NO: 2770 - DNA, 14 bp, Artificial sequence
  synthetic sequence
taacgctcccccgg

SEQ ID NO: 2771 - DNA, 14 bp, Artificial sequence
  synthetic sequence
cactctagcggccg

SEQ ID NO: 2772 - DNA, 14 bp, Artificial sequence
  synthetic sequence
aagggagcgattcg

SEQ ID NO: 2773 - DNA, 14 bp, Artificial sequence
  synthetic sequence
gaccgaatcgaggt

SEQ ID NO: 2774 - DNA, 14 bp, Artificial sequence
  synthetic sequence
cacgtaagaagctc

SEQ ID NO: 2775 - DNA, 14 bp, Artificial sequence
  synthetic sequence
aacgagggatactc

SEQ ID NO: 2776 - DNA, 14 bp, Artificial sequence
  synthetic sequence
cagtcacgcgccct

SEQ ID NO: 2777 - DNA, 14 bp, Artificial sequence
  synthetic sequence
gcaaagtgctccac

SEQ ID NO: 2778 - DNA, 14 bp, Artificial sequence
  synthetic sequence
gcacgcagacgtct

SEQ ID NO: 2779 - DNA, 14 bp, Artificial sequence
  synthetic sequence
agagcgcgatgcct

SEQ ID NO: 2780 - DNA, 14 bp, Artificial sequence
  synthetic sequence
aatgagctcaaaaa

SEQ ID NO: 2781 - DNA, 14 bp, Artificial sequence
  synthetic sequence
aacctgagcgcctc

SEQ ID NO: 2782 - DNA, 14 bp, Artificial sequence
  synthetic sequence
ccccagtggcaata

SEQ ID NO: 2783 - DNA, 14 bp, Artificial sequence
  synthetic sequence
gaccgcaggaattc

SEQ ID NO: 2784 - DNA, 14 bp, Artificial sequence
  synthetic sequence
tagccacagcggtc

SEQ ID NO: 2785 - DNA, 14 bp, Artificial sequence
  synthetic sequence
aaagtcaggcacta

SEQ ID NO: 2786 - DNA, 14 bp, Artificial sequence
  synthetic sequence
cgaccagggctata

SEQ ID NO: 2787 - DNA, 14 bp, Artificial sequence
  synthetic sequence
ccataagctcagaa

SEQ ID NO: 2788 - DNA, 14 bp, Artificial sequence
  synthetic sequence
aggcctagagactc

SEQ ID NO: 2789 - DNA, 14 bp, Artificial sequence
  synthetic sequence
taacagggaaaatg

SEQ ID NO: 2790 - DNA, 14 bp, Artificial sequence
  synthetic sequence
tacggaggaatccc

SEQ ID NO: 2791 - DNA, 14 bp, Artificial sequence
  synthetic sequence
cactgggtaaacgg

SEQ ID NO: 2792 - DNA, 14 bp, Artificial sequence
  synthetic sequence
cttagcgcgcggcc

SEQ ID NO: 2793 - DNA, 14 bp, Artificial sequence
  synthetic sequence
gctcagaaccggat

SEQ ID NO: 2794 - DNA, 14 bp, Artificial sequence
  synthetic sequence
ctagtgggcaacaa

SEQ ID NO: 2795 - DNA, 14 bp, Artificial sequence
  synthetic sequence
cctgtagcccccca

SEQ ID NO: 2796 - DNA, 14 bp, Artificial sequence
  synthetic sequence
taacaggatggcca

SEQ ID NO: 2797 - DNA, 14 bp, Artificial sequence
  synthetic sequence
cgggaactgagagt

SEQ ID NO: 2798 - DNA, 14 bp, Artificial sequence
  synthetic sequence
ctgcgcagcccact

SEQ ID NO: 2799 - DNA, 14 bp, Artificial sequence
  synthetic sequence
ccggacataagtac

SEQ ID NO: 2800 - DNA, 14 bp, Artificial sequence
  synthetic sequence
gtccaacatgcaca

SEQ ID NO: 2801 - DNA, 14 bp, Artificial sequence
  synthetic sequence
tgacaagtagagaa

SEQ ID NO: 2802 - DNA, 14 bp, Artificial sequence
  synthetic sequence
ttcgacgaccggaa

SEQ ID NO: 2803 - DNA, 14 bp, Artificial sequence
  synthetic sequence
cgactgccacccgt

SEQ ID NO: 2804 - DNA, 14 bp, Artificial sequence
  synthetic sequence
aactaactaaacgc

SEQ ID NO: 2805 - DNA, 14 bp, Artificial sequence
  synthetic sequence
caagagaggtgggt

SEQ ID NO: 2806 - DNA, 14 bp, Artificial sequence
  synthetic sequence
tcggtcagaccaga

SEQ ID NO: 2807 - DNA, 14 bp, Artificial sequence
  synthetic sequence
cggatcgaaggaat

SEQ ID NO: 2808 - DNA, 14 bp, Artificial sequence
  synthetic sequence
catgaaactgccgg

SEQ ID NO: 2809 - DNA, 14 bp, Artificial sequence
  synthetic sequence
cgcattcgccgcca

SEQ ID NO: 2810 - DNA, 14 bp, Artificial sequence
  synthetic sequence
actaacctgcccgg

SEQ ID NO: 2811 - DNA, 14 bp, Artificial sequence
  synthetic sequence
gcaccgaccttgaa

SEQ ID NO: 2812 - DNA, 14 bp, Artificial sequence
  synthetic sequence
actgccccagtcag

SEQ ID NO: 2813 - DNA, 14 bp, Artificial sequence
  synthetic sequence
atacccgacggtcg

SEQ ID NO: 2814 - DNA, 14 bp, Artificial sequence
  synthetic sequence
tgagcctaaaaagc

SEQ ID NO: 2815 - DNA, 14 bp, Artificial sequence
  synthetic sequence
gatcgcgcactaaa

SEQ ID NO: 2816 - DNA, 14 bp, Artificial sequence
  synthetic sequence
taacacggccgcta

SEQ ID NO: 2817 - DNA, 14 bp, Artificial sequence
  synthetic sequence
tcgcgagcccacta

SEQ ID NO: 2818 - DNA, 14 bp, Artificial sequence
  synthetic sequence
ggccctgacacctg

SEQ ID NO: 2819 - DNA, 14 bp, Artificial sequence
  synthetic sequence
cgatagggaaacct

SEQ ID NO: 2820 - DNA, 14 bp, Artificial sequence
  synthetic sequence
tgactccaaagaga

SEQ ID NO: 2821 - DNA, 14 bp, Artificial sequence
  synthetic sequence
gcgccattagacgg

SEQ ID NO: 2822 - DNA, 14 bp, Artificial sequence
  synthetic sequence
ccccaaggatagtc

SEQ ID NO: 2823 - DNA, 14 bp, Artificial sequence
  synthetic sequence
caaagtgagcgtac

SEQ ID NO: 2824 - DNA, 14 bp, Artificial sequence
  synthetic sequence
ccataatacgcgac

SEQ ID NO: 2825 - DNA, 14 bp, Artificial sequence
  synthetic sequence
aggggtctagcggg

SEQ ID NO: 2826 - DNA, 14 bp, Artificial sequence
  synthetic sequence
cggacagagatctc

SEQ ID NO: 2827 - DNA, 14 bp, Artificial sequence
  synthetic sequence
gtacagcacgtcag

SEQ ID NO: 2828 - DNA, 14 bp, Artificial sequence
  synthetic sequence
aggcacatggtgag

SEQ ID NO: 2829 - DNA, 14 bp, Artificial sequence
  synthetic sequence
taagaacaatacca

SEQ ID NO: 2830 - DNA, 14 bp, Artificial sequence
  synthetic sequence
agagctaagatcag

SEQ ID NO: 2831 - DNA, 14 bp, Artificial sequence
  synthetic sequence
gctccacgtaagaa

SEQ ID NO: 2832 - DNA, 14 bp, Artificial sequence
  synthetic sequence
attgacaacgagcg

SEQ ID NO: 2833 - DNA, 14 bp, Artificial sequence
  synthetic sequence
ccacaagattccaa

SEQ ID NO: 2834 - DNA, 14 bp, Artificial sequence
  synthetic sequence
acacctcggtgcaa

SEQ ID NO: 2835 - DNA, 14 bp, Artificial sequence
  synthetic sequence
ctgagccagcggta

SEQ ID NO: 2836 - DNA, 14 bp, Artificial sequence
  synthetic sequence
actgagaccatgac

SEQ ID NO: 2837 - DNA, 14 bp, Artificial sequence
  synthetic sequence
ggagaatggatgcc

SEQ ID NO: 2838 - DNA, 14 bp, Artificial sequence
  synthetic sequence
cgcacgtacctaaa

SEQ ID NO: 2839 - DNA, 14 bp, Artificial sequence
  synthetic sequence
gccacgcttaaagg

SEQ ID NO: 2840 - DNA, 14 bp, Artificial sequence
  synthetic sequence
gacatacagcagct

SEQ ID NO: 2841 - DNA, 14 bp, Artificial sequence
  synthetic sequence
aaccatgatcgaac

SEQ ID NO: 2842 - DNA, 14 bp, Artificial sequence
  synthetic sequence
aagagtccgggaat

SEQ ID NO: 2843 - DNA, 14 bp, Artificial sequence
  synthetic sequence
actcgagcggatcg

SEQ ID NO: 2844 - DNA, 14 bp, Artificial sequence
  synthetic sequence
ttaaaaggcaccga

SEQ ID NO: 2845 - DNA, 14 bp, Artificial sequence
  synthetic sequence
gggataaatcagcc

SEQ ID NO: 2846 - DNA, 14 bp, Artificial sequence
  synthetic sequence
ctatcgaaagagac

SEQ ID NO: 2847 - DNA, 14 bp, Artificial sequence
  synthetic sequence
aaccacactcatcc

SEQ ID NO: 2848 - DNA, 14 bp, Artificial sequence
  synthetic sequence
aatcgtcgggaaag

SEQ ID NO: 2849 - DNA, 14 bp, Artificial sequence
  synthetic sequence
aataagggggtggc

SEQ ID NO: 2850 - DNA, 14 bp, Artificial sequence
  synthetic sequence
tagaacaagataca

SEQ ID NO: 2851 - DNA, 14 bp, Artificial sequence
  synthetic sequence
actcgcgagtaaaa

SEQ ID NO: 2852 - DNA, 14 bp, Artificial sequence
  synthetic sequence
gcgggtcaccctcg

SEQ ID NO: 2853 - DNA, 14 bp, Artificial sequence
  synthetic sequence
gcatctgcgcggca

SEQ ID NO: 2854 - DNA, 14 bp, Artificial sequence
  synthetic sequence
gttcacaggaaagc

SEQ ID NO: 2855 - DNA, 14 bp, Artificial sequence
  synthetic sequence
cccgtacatagaaa

SEQ ID NO: 2856 - DNA, 14 bp, Artificial sequence
  synthetic sequence
cccgcaacctgtaa

SEQ ID NO: 2857 - DNA, 14 bp, Artificial sequence
  synthetic sequence
gcgttacccgccgc

SEQ ID NO: 2858 - DNA, 14 bp, Artificial sequence
  synthetic sequence
gtagcacgatgcgg

SEQ ID NO: 2859 - DNA, 14 bp, Artificial sequence
  synthetic sequence
cggataaagagcat

SEQ ID NO: 2860 - DNA, 14 bp, Artificial sequence
  synthetic sequence
aagtacgcctccaa

SEQ ID NO: 2861 - DNA, 14 bp, Artificial sequence
  synthetic sequence
ggaaacgagattca

SEQ ID NO: 2862 - DNA, 14 bp, Artificial sequence
  synthetic sequence
ggagtgctgggcaa

SEQ ID NO: 2863 - DNA, 14 bp, Artificial sequence
  synthetic sequence
aacggggtgcgtcg

SEQ ID NO: 2864 - DNA, 14 bp, Artificial sequence
  synthetic sequence
gataagccctggca

SEQ ID NO: 2865 - DNA, 14 bp, Artificial sequence
  synthetic sequence
gggtgactcacagg

SEQ ID NO: 2866 - DNA, 14 bp, Artificial sequence
  synthetic sequence
tgagctagaaaaaa

SEQ ID NO: 2867 - DNA, 14 bp, Artificial sequence
  synthetic sequence
cagcctgccacatc

SEQ ID NO: 2868 - DNA, 14 bp, Artificial sequence
  synthetic sequence
taatcaaacaagca

SEQ ID NO: 2869 - DNA, 14 bp, Artificial sequence
  synthetic sequence
cacgtgggcaatgg

SEQ ID NO: 2870 - DNA, 14 bp, Artificial sequence
  synthetic sequence
ggcctagagtccac

SEQ ID NO: 2871 - DNA, 14 bp, Artificial sequence
  synthetic sequence
cccttcggaggggg

SEQ ID NO: 2872 - DNA, 14 bp, Artificial sequence
  synthetic sequence
agcatagagatagc

SEQ ID NO: 2873 - DNA, 14 bp, Artificial sequence
  synthetic sequence
cacagaatatggac

SEQ ID NO: 2874 - DNA, 14 bp, Artificial sequence
  synthetic sequence
aagtaccaccgtcg

SEQ ID NO: 2875 - DNA, 14 bp, Artificial sequence
  synthetic sequence
tcaactaagagggc

SEQ ID NO: 2876 - DNA, 14 bp, Artificial sequence
  synthetic sequence
ggggcaagcatatg

SEQ ID NO: 2877 - DNA, 14 bp, Artificial sequence
  synthetic sequence
tgtagcaaaccgcc

SEQ ID NO: 2878 - DNA, 14 bp, Artificial sequence
  synthetic sequence
cccaacgacattaa

SEQ ID NO: 2879 - DNA, 14 bp, Artificial sequence
  synthetic sequence
atggcggatacctg

SEQ ID NO: 2880 - DNA, 14 bp, Artificial sequence
  synthetic sequence
caagatatcatccg

SEQ ID NO: 2881 - DNA, 14 bp, Artificial sequence
  synthetic sequence
atgcagtgcgctac

SEQ ID NO: 2882 - DNA, 14 bp, Artificial sequence
  synthetic sequence
cagccgctgatatg

SEQ ID NO: 2883 - DNA, 14 bp, Artificial sequence
  synthetic sequence
cccgttcagcatag

SEQ ID NO: 2884 - DNA, 14 bp, Artificial sequence
  synthetic sequence
gaccaagttggcta

SEQ ID NO: 2885 - DNA, 14 bp, Artificial sequence
  synthetic sequence
cgcggaacgctttc

SEQ ID NO: 2886 - DNA, 14 bp, Artificial sequence
  synthetic sequence
ggttggcctggcgg

SEQ ID NO: 2887 - DNA, 14 bp, Artificial sequence
  synthetic sequence
gctatgatcgccaa

SEQ ID NO: 2888 - DNA, 14 bp, Artificial sequence
  synthetic sequence
agcgctttagcacg

SEQ ID NO: 2889 - DNA, 14 bp, Artificial sequence
  synthetic sequence
ctgctctgacggag

SEQ ID NO: 2890 - DNA, 14 bp, Artificial sequence
  synthetic sequence
tggggcatgctcgg

SEQ ID NO: 2891 - DNA, 14 bp, Artificial sequence
  synthetic sequence
cttgccggaactcc

SEQ ID NO: 2892 - DNA, 14 bp, Artificial sequence
  synthetic sequence
gctgcacatctccc

SEQ ID NO: 2893 - DNA, 14 bp, Artificial sequence
  synthetic sequence
cgaatttgccccac

SEQ ID NO: 2894 - DNA, 14 bp, Artificial sequence
  synthetic sequence
cggatgtaacctgc

SEQ ID NO: 2895 - DNA, 14 bp, Artificial sequence
  synthetic sequence
caccaatcgtgagt

SEQ ID NO: 2896 - DNA, 14 bp, Artificial sequence
  synthetic sequence
acaagatagttaaa

SEQ ID NO: 2897 - DNA, 14 bp, Artificial sequence
  synthetic sequence
ttctgggaagcgga

SEQ ID NO: 2898 - DNA, 14 bp, Artificial sequence
  synthetic sequence
catggaataaacgt

SEQ ID NO: 2899 - DNA, 14 bp, Artificial sequence
  synthetic sequence
ctgtcaagaacact

SEQ ID NO: 2900 - DNA, 14 bp, Artificial sequence
  synthetic sequence
cagatggatctacc

SEQ ID NO: 2901 - DNA, 14 bp, Artificial sequence
  synthetic sequence
acgagatatggtgc

SEQ ID NO: 2902 - DNA, 14 bp, Artificial sequence
  synthetic sequence
ttactgcgcacaaa

SEQ ID NO: 2903 - DNA, 14 bp, Artificial sequence
  synthetic sequence
gtcaatctaagaaa

SEQ ID NO: 2904 - DNA, 14 bp, Artificial sequence
  synthetic sequence
gggagcgtgtggat

SEQ ID NO: 2905 - DNA, 14 bp, Artificial sequence
  synthetic sequence
tgacacatctgcgg

SEQ ID NO: 2906 - DNA, 14 bp, Artificial sequence
  synthetic sequence
ttaccgccacgtag

SEQ ID NO: 2907 - DNA, 14 bp, Artificial sequence
  synthetic sequence
agtacatccagtcc

SEQ ID NO: 2908 - DNA, 14 bp, Artificial sequence
  synthetic sequence
ctcaacgacgtctc

SEQ ID NO: 2909 - DNA, 14 bp, Artificial sequence
  synthetic sequence
gaatcgcatgggtc

SEQ ID NO: 2910 - DNA, 14 bp, Artificial sequence
  synthetic sequence
tggacacgagcctt

SEQ ID NO: 2911 - DNA, 14 bp, Artificial sequence
  synthetic sequence
cctacgttggcaag

SEQ ID NO: 2912 - DNA, 14 bp, Artificial sequence
  synthetic sequence
gtcaccgattgcga

SEQ ID NO: 2913 - DNA, 14 bp, Artificial sequence
  synthetic sequence
cgggtcctaacatc

SEQ ID NO: 2914 - DNA, 14 bp, Artificial sequence
  synthetic sequence
ttgtccgcaccacc

SEQ ID NO: 2915 - DNA, 14 bp, Artificial sequence
  synthetic sequence
ccagccacttctgg

SEQ ID NO: 2916 - DNA, 14 bp, Artificial sequence
  synthetic sequence
agacatacctggta

SEQ ID NO: 2917 - DNA, 14 bp, Artificial sequence
  synthetic sequence
gctaaccgtcgcat

SEQ ID NO: 2918 - DNA, 14 bp, Artificial sequence
  synthetic sequence
tgtggaagcatgag

SEQ ID NO: 2919 - DNA, 14 bp, Artificial sequence
  synthetic sequence
caggcctgtaccgt

SEQ ID NO: 2920 - DNA, 14 bp, Artificial sequence
  synthetic sequence
tctgtccgaaggac

SEQ ID NO: 2921 - DNA, 14 bp, Artificial sequence
  synthetic sequence
acaacgtgctgatg

SEQ ID NO: 2922 - DNA, 14 bp, Artificial sequence
  synthetic sequence
gtcacagttcaaac

SEQ ID NO: 2923 - DNA, 14 bp, Artificial sequence
  synthetic sequence
cagggcgttataac

SEQ ID NO: 2924 - DNA, 14 bp, Artificial sequence
  synthetic sequence
ccggaatgctctaa

SEQ ID NO: 2925 - DNA, 14 bp, Artificial sequence
  synthetic sequence
accttccagactag

SEQ ID NO: 2926 - DNA, 14 bp, Artificial sequence
  synthetic sequence
tcaaatcaactacg

SEQ ID NO: 2927 - DNA, 14 bp, Artificial sequence
  synthetic sequence
cagtggctctcggc

SEQ ID NO: 2928 - DNA, 14 bp, Artificial sequence
  synthetic sequence
tagtgtcaaacaca

SEQ ID NO: 2929 - DNA, 14 bp, Artificial sequence
  synthetic sequence
tgagaaaatgcagt

SEQ ID NO: 2930 - DNA, 14 bp, Artificial sequence
  synthetic sequence
tcaatctagaggaa

SEQ ID NO: 2931 - DNA, 14 bp, Artificial sequence
  synthetic sequence
cgcctgtgatcgcg

SEQ ID NO: 2932 - DNA, 14 bp, Artificial sequence
  synthetic sequence
actacttaaaagga

SEQ ID NO: 2933 - DNA, 14 bp, Artificial sequence
  synthetic sequence
gcgataattcacaa

SEQ ID NO: 2934 - DNA, 14 bp, Artificial sequence
  synthetic sequence
acgaagggttacct

SEQ ID NO: 2935 - DNA, 14 bp, Artificial sequence
  synthetic sequence
gggcagaataatgt

SEQ ID NO: 2936 - DNA, 14 bp, Artificial sequence
  synthetic sequence
ccggatcacttagg

SEQ ID NO: 2937 - DNA, 14 bp, Artificial sequence
  synthetic sequence
ctcccaatgctccc

SEQ ID NO: 2938 - DNA, 14 bp, Artificial sequence
  synthetic sequence
gggttcaggtcgaa

SEQ ID NO: 2939 - DNA, 14 bp, Artificial sequence
  synthetic sequence
cgtgcataccgcat

SEQ ID NO: 2940 - DNA, 14 bp, Artificial sequence
  synthetic sequence
ctctcgccactaac

SEQ ID NO: 2941 - DNA, 14 bp, Artificial sequence
  synthetic sequence
ccttcgagtgccgc

SEQ ID NO: 2942 - DNA, 14 bp, Artificial sequence
  synthetic sequence
gttggtggacgacc

SEQ ID NO: 2943 - DNA, 14 bp, Artificial sequence
  synthetic sequence
cccgtgggtgacta

SEQ ID NO: 2944 - DNA, 14 bp, Artificial sequence
  synthetic sequence
gtaaactgtcccgc

SEQ ID NO: 2945 - DNA, 14 bp, Artificial sequence
  synthetic sequence
atggaggggttcac

SEQ ID NO: 2946 - DNA, 14 bp, Artificial sequence
  synthetic sequence
atgcggctcggggt

SEQ ID NO: 2947 - DNA, 14 bp, Artificial sequence
  synthetic sequence
agcgcgtacgcgtt

SEQ ID NO: 2948 - DNA, 14 bp, Artificial sequence
  synthetic sequence
acgagcatgtgcta

SEQ ID NO: 2949 - DNA, 14 bp, Artificial sequence
  synthetic sequence
cccgattcatgagc

SEQ ID NO: 2950 - DNA, 14 bp, Artificial sequence
  synthetic sequence
cgacttcgtcgggc

SEQ ID NO: 2951 - DNA, 14 bp, Artificial sequence
  synthetic sequence
cacctattaaaggc

SEQ ID NO: 2952 - DNA, 14 bp, Artificial sequence
  synthetic sequence
actgtgtggcagga

SEQ ID NO: 2953 - DNA, 14 bp, Artificial sequence
  synthetic sequence
tatggaaatcacgc

SEQ ID NO: 2954 - DNA, 14 bp, Artificial sequence
  synthetic sequence
cgataccccgtcgt

SEQ ID NO: 2955 - DNA, 14 bp, Artificial sequence
  synthetic sequence
gcgcgatggaatta

SEQ ID NO: 2956 - DNA, 14 bp, Artificial sequence
  synthetic sequence
agggtttaaaggaa

SEQ ID NO: 2957 - DNA, 14 bp, Artificial sequence
  synthetic sequence
gggttggtgcaaaa

SEQ ID NO: 2958 - DNA, 14 bp, Artificial sequence
  synthetic sequence
taacacccatgatg

SEQ ID NO: 2959 - DNA, 14 bp, Artificial sequence
  synthetic sequence
gctagggcgattaa

SEQ ID NO: 2960 - DNA, 14 bp, Artificial sequence
  synthetic sequence
aggacaaatgttag

SEQ ID NO: 2961 - DNA, 14 bp, Artificial sequence
  synthetic sequence
cttgaggagtccag

SEQ ID NO: 2962 - DNA, 14 bp, Artificial sequence
  synthetic sequence
ctcagatcaaacat

SEQ ID NO: 2963 - DNA, 14 bp, Artificial sequence
  synthetic sequence
tcggcacgggagtt

SEQ ID NO: 2964 - DNA, 14 bp, Artificial sequence
  synthetic sequence
gcgaccaagttcct

SEQ ID NO: 2965 - DNA, 14 bp, Artificial sequence
  synthetic sequence
tgctcacatcggca

SEQ ID NO: 2966 - DNA, 14 bp, Artificial sequence
  synthetic sequence
catggctaacgcgt

SEQ ID NO: 2967 - DNA, 14 bp, Artificial sequence
  synthetic sequence
ctgcatagatgcgc

SEQ ID NO: 2968 - DNA, 14 bp, Artificial sequence
  synthetic sequence
tccgagtgaggctg

SEQ ID NO: 2969 - DNA, 14 bp, Artificial sequence
  synthetic sequence
tgtcgacagcgtac

SEQ ID NO: 2970 - DNA, 14 bp, Artificial sequence
  synthetic sequence
cccctacacccctt

SEQ ID NO: 2971 - DNA, 14 bp, Artificial sequence
  synthetic sequence
ctgtctaaggagca

SEQ ID NO: 2972 - DNA, 14 bp, Artificial sequence
  synthetic sequence
caccgtcatgtgac

SEQ ID NO: 2973 - DNA, 14 bp, Artificial sequence
  synthetic sequence
ttccgcactagacc

SEQ ID NO: 2974 - DNA, 14 bp, Artificial sequence
  synthetic sequence
ccagatgtcgatcg

SEQ ID NO: 2975 - DNA, 14 bp, Artificial sequence
  synthetic sequence
ttatgcagcagcag

SEQ ID NO: 2976 - DNA, 14 bp, Artificial sequence
  synthetic sequence
gtggacaaactctc

SEQ ID NO: 2977 - DNA, 14 bp, Artificial sequence
  synthetic sequence
gccacctcaatgta

SEQ ID NO: 2978 - DNA, 14 bp, Artificial sequence
  synthetic sequence
cttcgagacgtgcg

SEQ ID NO: 2979 - DNA, 14 bp, Artificial sequence
  synthetic sequence
gactaaccgatagt

SEQ ID NO: 2980 - DNA, 14 bp, Artificial sequence
  synthetic sequence
gagtcaaaacttcc

SEQ ID NO: 2981 - DNA, 14 bp, Artificial sequence
  synthetic sequence
cgtaagtgccgaat

SEQ ID NO: 2982 - DNA, 14 bp, Artificial sequence
  synthetic sequence
gtaagctctaaacg

SEQ ID NO: 2983 - DNA, 14 bp, Artificial sequence
  synthetic sequence
cgaaaatggtatag

SEQ ID NO: 2984 - DNA, 14 bp, Artificial sequence
  synthetic sequence
gggattgctagcgc

SEQ ID NO: 2985 - DNA, 14 bp, Artificial sequence
  synthetic sequence
actcaagaatcagt

SEQ ID NO: 2986 - DNA, 14 bp, Artificial sequence
  synthetic sequence
cgccgaaagtgtat

SEQ ID NO: 2987 - DNA, 14 bp, Artificial sequence
  synthetic sequence
cgcgttactacaag

SEQ ID NO: 2988 - DNA, 14 bp, Artificial sequence
  synthetic sequence
tatggtaagggccg

SEQ ID NO: 2989 - DNA, 14 bp, Artificial sequence
  synthetic sequence
tctgactgcgccga

SEQ ID NO: 2990 - DNA, 14 bp, Artificial sequence
  synthetic sequence
ccagtgctatgaag

SEQ ID NO: 2991 - DNA, 14 bp, Artificial sequence
  synthetic sequence
acctacaagcattc

SEQ ID NO: 2992 - DNA, 14 bp, Artificial sequence
  synthetic sequence
ggattataaccgca

SEQ ID NO: 2993 - DNA, 14 bp, Artificial sequence
  synthetic sequence
tcctaaagagctgg

SEQ ID NO: 2994 - DNA, 14 bp, Artificial sequence
  synthetic sequence
gctaaatgaatcag

SEQ ID NO: 2995 - DNA, 14 bp, Artificial sequence
  synthetic sequence
ctaaacctccccat

SEQ ID NO: 2996 - DNA, 14 bp, Artificial sequence
  synthetic sequence
atgatgacgtaaca

SEQ ID NO: 2997 - DNA, 14 bp, Artificial sequence
  synthetic sequence
tcggcgaagtctag

SEQ ID NO: 2998 - DNA, 14 bp, Artificial sequence
  synthetic sequence
gcacctcttccgcg

SEQ ID NO: 2999 - DNA, 14 bp, Artificial sequence
  synthetic sequence
tacaatggcggtac

SEQ ID NO: 3000 - DNA, 14 bp, Artificial sequence
  synthetic sequence
cgtactctgcacag

SEQ ID NO: 3001 - DNA, 14 bp, Artificial sequence
  synthetic sequence
aggatccgatctca

SEQ ID NO: 3002 - DNA, 14 bp, Artificial sequence
  synthetic sequence
cccgtccctacctc

SEQ ID NO: 3003 - DNA, 14 bp, Artificial sequence
  synthetic sequence
cggtatctaagcga

SEQ ID NO: 3004 - DNA, 14 bp, Artificial sequence
  synthetic sequence
cacgttccacactc

SEQ ID NO: 3005 - DNA, 14 bp, Artificial sequence
  synthetic sequence
cggattccccactg

SEQ ID NO: 3006 - DNA, 14 bp, Artificial sequence
  synthetic sequence
cccctcaacctgta

SEQ ID NO: 3007 - DNA, 14 bp, Artificial sequence
  synthetic sequence
caaggtacatggtc

SEQ ID NO: 3008 - DNA, 14 bp, Artificial sequence
  synthetic sequence
acgcatagtctgaa

SEQ ID NO: 3009 - DNA, 14 bp, Artificial sequence
  synthetic sequence
tcgttgaaaaacaa

SEQ ID NO: 3010 - DNA, 14 bp, Artificial sequence
  synthetic sequence
gcgaggagttaagt

SEQ ID NO: 3011 - DNA, 14 bp, Artificial sequence
  synthetic sequence
cgaagtgatcggta

SEQ ID NO: 3012 - DNA, 14 bp, Artificial sequence
  synthetic sequence
tctgcgcagccgct

SEQ ID NO: 3013 - DNA, 14 bp, Artificial sequence
  synthetic sequence
gagcactgatcagt

SEQ ID NO: 3014 - DNA, 14 bp, Artificial sequence
  synthetic sequence
gcacgtggagtggt

SEQ ID NO: 3015 - DNA, 14 bp, Artificial sequence
  synthetic sequence
gacctctagccact

SEQ ID NO: 3016 - DNA, 14 bp, Artificial sequence
  synthetic sequence
tcgattgccagcaa

SEQ ID NO: 3017 - DNA, 14 bp, Artificial sequence
  synthetic sequence
ccttaaaaagtaca

SEQ ID NO: 3018 - DNA, 14 bp, Artificial sequence
  synthetic sequence
gtcaaggagttacg

SEQ ID NO: 3019 - DNA, 14 bp, Artificial sequence
  synthetic sequence
aaatggcatctccc

SEQ ID NO: 3020 - DNA, 14 bp, Artificial sequence
  synthetic sequence
caggttgcagtagc

SEQ ID NO: 3021 - DNA, 14 bp, Artificial sequence
  synthetic sequence
cgaattacacctca

SEQ ID NO: 3022 - DNA, 14 bp, Artificial sequence
  synthetic sequence
gctgcagggctgta

SEQ ID NO: 3023 - DNA, 14 bp, Artificial sequence
  synthetic sequence
cgccctctcaaata

SEQ ID NO: 3024 - DNA, 14 bp, Artificial sequence
  synthetic sequence
ccgttaggatcacc

SEQ ID NO: 3025 - DNA, 14 bp, Artificial sequence
  synthetic sequence
tccgggatgatcga

SEQ ID NO: 3026 - DNA, 14 bp, Artificial sequence
  synthetic sequence
acgtataggtgagc

SEQ ID NO: 3027 - DNA, 14 bp, Artificial sequence
  synthetic sequence
tccaccaggtcgat

SEQ ID NO: 3028 - DNA, 14 bp, Artificial sequence
  synthetic sequence
ccaaccctttagaa

SEQ ID NO: 3029 - DNA, 14 bp, Artificial sequence
  synthetic sequence
atagtaggactgac

SEQ ID NO: 3030 - DNA, 14 bp, Artificial sequence
  synthetic sequence
agcgcatctccagt

SEQ ID NO: 3031 - DNA, 14 bp, Artificial sequence
  synthetic sequence
cttacaaagactaa

SEQ ID NO: 3032 - DNA, 14 bp, Artificial sequence
  synthetic sequence
gatgcacctgcctc

SEQ ID NO: 3033 - DNA, 14 bp, Artificial sequence
  synthetic sequence
agggagcccttgct

SEQ ID NO: 3034 - DNA, 14 bp, Artificial sequence
  synthetic sequence
tagatgcatcccga

SEQ ID NO: 3035 - DNA, 14 bp, Artificial sequence
  synthetic sequence
agcgtgttcacgcg

SEQ ID NO: 3036 - DNA, 14 bp, Artificial sequence
  synthetic sequence
agttcgaccggctc

SEQ ID NO: 3037 - DNA, 14 bp, Artificial sequence
  synthetic sequence
ccaagcgctttgag

SEQ ID NO: 3038 - DNA, 14 bp, Artificial sequence
  synthetic sequence
aggacggcttgatc

SEQ ID NO: 3039 - DNA, 14 bp, Artificial sequence
  synthetic sequence
tcactaagaaataa

SEQ ID NO: 3040 - DNA, 14 bp, Artificial sequence
  synthetic sequence
cgctggatgacgtg

SEQ ID NO: 3041 - DNA, 14 bp, Artificial sequence
  synthetic sequence
tacgagctgcctag

SEQ ID NO: 3042 - DNA, 14 bp, Artificial sequence
  synthetic sequence
cgctccggtatggg

SEQ ID NO: 3043 - DNA, 14 bp, Artificial sequence
  synthetic sequence
ctcgcctatagccc

SEQ ID NO: 3044 - DNA, 14 bp, Artificial sequence
  synthetic sequence
ggaggctctctccg

SEQ ID NO: 3045 - DNA, 14 bp, Artificial sequence
  synthetic sequence
aaagtgcaaattac

SEQ ID NO: 3046 - DNA, 14 bp, Artificial sequence
  synthetic sequence
taaagactaggtga

SEQ ID NO: 3047 - DNA, 14 bp, Artificial sequence
  synthetic sequence
gacaaccaattcta

SEQ ID NO: 3048 - DNA, 14 bp, Artificial sequence
  synthetic sequence
gcagcctgaggctt

SEQ ID NO: 3049 - DNA, 14 bp, Artificial sequence
  synthetic sequence
ggtagaaaatatgc

SEQ ID NO: 3050 - DNA, 14 bp, Artificial sequence
  synthetic sequence
atctacgagatcgc

SEQ ID NO: 3051 - DNA, 14 bp, Artificial sequence
  synthetic sequence
gatttcgcacacca

SEQ ID NO: 3052 - DNA, 14 bp, Artificial sequence
  synthetic sequence
atgttgaagggcca

SEQ ID NO: 3053 - DNA, 14 bp, Artificial sequence
  synthetic sequence
ttacagcgcgaagt

SEQ ID NO: 3054 - DNA, 14 bp, Artificial sequence
  synthetic sequence
tatgagcctaccaa

SEQ ID NO: 3055 - DNA, 14 bp, Artificial sequence
  synthetic sequence
tcaggtggctcgaa

SEQ ID NO: 3056 - DNA, 14 bp, Artificial sequence
  synthetic sequence
acctaatacggcgt

SEQ ID NO: 3057 - DNA, 14 bp, Artificial sequence
  synthetic sequence
ggccagaaatcttg

SEQ ID NO: 3058 - DNA, 14 bp, Artificial sequence
  synthetic sequence
gtcgtatgcgcgaa

SEQ ID NO: 3059 - DNA, 14 bp, Artificial sequence
  synthetic sequence
cagctaggtgtggc

SEQ ID NO: 3060 - DNA, 14 bp, Artificial sequence
  synthetic sequence
gacctgggcctatg

SEQ ID NO: 3061 - DNA, 14 bp, Artificial sequence
  synthetic sequence
aaaggatagtctgc

SEQ ID NO: 3062 - DNA, 14 bp, Artificial sequence
  synthetic sequence
tgaggcaggtcgta

SEQ ID NO: 3063 - DNA, 14 bp, Artificial sequence
  synthetic sequence
cccgtttgcacggc

SEQ ID NO: 3064 - DNA, 14 bp, Artificial sequence
  synthetic sequence
gctaccaagtgatc

SEQ ID NO: 3065 - DNA, 14 bp, Artificial sequence
  synthetic sequence
agtgctgtaagccg

SEQ ID NO: 3066 - DNA, 14 bp, Artificial sequence
  synthetic sequence
gcgactgatctgcc

SEQ ID NO: 3067 - DNA, 14 bp, Artificial sequence
  synthetic sequence
ccgcgttactcgac

SEQ ID NO: 3068 - DNA, 14 bp, Artificial sequence
  synthetic sequence
gggtggagtatgaa

SEQ ID NO: 3069 - DNA, 14 bp, Artificial sequence
  synthetic sequence
tccaaacgcattcc

SEQ ID NO: 3070 - DNA, 14 bp, Artificial sequence
  synthetic sequence
ccctcaagcctctg

SEQ ID NO: 3071 - DNA, 14 bp, Artificial sequence
  synthetic sequence
cttcgcctaagccc

SEQ ID NO: 3072 - DNA, 14 bp, Artificial sequence
  synthetic sequence
atcctagcgggctg

SEQ ID NO: 3073 - DNA, 14 bp, Artificial sequence
  synthetic sequence
agacggcttgaatc

SEQ ID NO: 3074 - DNA, 14 bp, Artificial sequence
  synthetic sequence
tccgtagcgtccgg

SEQ ID NO: 3075 - DNA, 14 bp, Artificial sequence
  synthetic sequence
cgaacccgtcctat

SEQ ID NO: 3076 - DNA, 14 bp, Artificial sequence
  synthetic sequence
ctagttcgacccgg

SEQ ID NO: 3077 - DNA, 14 bp, Artificial sequence
  synthetic sequence
atccattgcacgaa

SEQ ID NO: 3078 - DNA, 14 bp, Artificial sequence
  synthetic sequence
acagtcataactaa

SEQ ID NO: 3079 - DNA, 14 bp, Artificial sequence
  synthetic sequence
cttagctgcgacgg

SEQ ID NO: 3080 - DNA, 14 bp, Artificial sequence
  synthetic sequence
taattaacccaggg

SEQ ID NO: 3081 - DNA, 14 bp, Artificial sequence
  synthetic sequence
cacgatacagtgct

SEQ ID NO: 3082 - DNA, 14 bp, Artificial sequence
  synthetic sequence
actgctggaatcaa

SEQ ID NO: 3083 - DNA, 14 bp, Artificial sequence
  synthetic sequence
tgtagggcctggga

SEQ ID NO: 3084 - DNA, 14 bp, Artificial sequence
  synthetic sequence
cggtcacctacgta

SEQ ID NO: 3085 - DNA, 14 bp, Artificial sequence
  synthetic sequence
aaagcgctctatcg

SEQ ID NO: 3086 - DNA, 14 bp, Artificial sequence
  synthetic sequence
ctatgagaagtccc

SEQ ID NO: 3087 - DNA, 14 bp, Artificial sequence
  synthetic sequence
aaccaccagctttg

SEQ ID NO: 3088 - DNA, 14 bp, Artificial sequence
  synthetic sequence
agtctacagccata

SEQ ID NO: 3089 - DNA, 14 bp, Artificial sequence
  synthetic sequence
caaataactctaca

SEQ ID NO: 3090 - DNA, 14 bp, Artificial sequence
  synthetic sequence
caatgcccactgat

SEQ ID NO: 3091 - DNA, 14 bp, Artificial sequence
  synthetic sequence
agctccatccccgt

SEQ ID NO: 3092 - DNA, 14 bp, Artificial sequence
  synthetic sequence
tagcagatagagtc

SEQ ID NO: 3093 - DNA, 14 bp, Artificial sequence
  synthetic sequence
ccagtttagagcca

SEQ ID NO: 3094 - DNA, 14 bp, Artificial sequence
  synthetic sequence
tgtctaaccgccaa

SEQ ID NO: 3095 - DNA, 14 bp, Artificial sequence
  synthetic sequence
gctagaaatatggc

SEQ ID NO: 3096 - DNA, 14 bp, Artificial sequence
  synthetic sequence
ctcgaaaccattac

SEQ ID NO: 3097 - DNA, 14 bp, Artificial sequence
  synthetic sequence
actggatggatcgc

SEQ ID NO: 3098 - DNA, 14 bp, Artificial sequence
  synthetic sequence
cagatagtcaaact

SEQ ID NO: 3099 - DNA, 14 bp, Artificial sequence
  synthetic sequence
atgaggaattgcag

SEQ ID NO: 3100 - DNA, 14 bp, Artificial sequence
  synthetic sequence
gctatggctcacac

SEQ ID NO: 3101 - DNA, 14 bp, Artificial sequence
  synthetic sequence
ggaaatgtcatcaa

SEQ ID NO: 3102 - DNA, 14 bp, Artificial sequence
  synthetic sequence
cgcattcgagcgtc

SEQ ID NO: 3103 - DNA, 14 bp, Artificial sequence
  synthetic sequence
cccgtggtgctcac

SEQ ID NO: 3104 - DNA, 14 bp, Artificial sequence
  synthetic sequence
aaagtactcccact

SEQ ID NO: 3105 - DNA, 14 bp, Artificial sequence
  synthetic sequence
attaactggagaaa

SEQ ID NO: 3106 - DNA, 14 bp, Artificial sequence
  synthetic sequence
aactcacacattca

SEQ ID NO: 3107 - DNA, 14 bp, Artificial sequence
  synthetic sequence
gcacttaacgggct

SEQ ID NO: 3108 - DNA, 14 bp, Artificial sequence
  synthetic sequence
agggtgctagggta

SEQ ID NO: 3109 - DNA, 14 bp, Artificial sequence
  synthetic sequence
accgctgtcgtagc

SEQ ID NO: 3110 - DNA, 14 bp, Artificial sequence
  synthetic sequence
tcatatacaaggcg

SEQ ID NO: 3111 - DNA, 14 bp, Artificial sequence
  synthetic sequence
gaaaagactccctt

SEQ ID NO: 3112 - DNA, 14 bp, Artificial sequence
  synthetic sequence
cagatgtacggtga

SEQ ID NO: 3113 - DNA, 14 bp, Artificial sequence
  synthetic sequence
tgagtggacaccgt

SEQ ID NO: 3114 - DNA, 14 bp, Artificial sequence
  synthetic sequence
taaaacaggggtct

SEQ ID NO: 3115 - DNA, 14 bp, Artificial sequence
  synthetic sequence
agaccgttatccgc

SEQ ID NO: 3116 - DNA, 14 bp, Artificial sequence
  synthetic sequence
agctatcaaaataa

SEQ ID NO: 3117 - DNA, 14 bp, Artificial sequence
  synthetic sequence
ttgcgccacacctc

SEQ ID NO: 3118 - DNA, 14 bp, Artificial sequence
  synthetic sequence
gataaacggcgttc

SEQ ID NO: 3119 - DNA, 14 bp, Artificial sequence
  synthetic sequence
gtagtgggccaagt

SEQ ID NO: 3120 - DNA, 14 bp, Artificial sequence
  synthetic sequence
tggcactaacacct

SEQ ID NO: 3121 - DNA, 14 bp, Artificial sequence
  synthetic sequence
gtcaaaacgctgtc

SEQ ID NO: 3122 - DNA, 14 bp, Artificial sequence
  synthetic sequence
gggttacgcaccat

SEQ ID NO: 3123 - DNA, 14 bp, Artificial sequence
  synthetic sequence
tactggaggagtga

SEQ ID NO: 3124 - DNA, 14 bp, Artificial sequence
  synthetic sequence
gacgaacgagtttg

SEQ ID NO: 3125 - DNA, 14 bp, Artificial sequence
  synthetic sequence
agccgaattggtaa

SEQ ID NO: 3126 - DNA, 14 bp, Artificial sequence
  synthetic sequence
ccgagccacttctc

SEQ ID NO: 3127 - DNA, 14 bp, Artificial sequence
  synthetic sequence
gtgccacctaggct

SEQ ID NO: 3128 - DNA, 14 bp, Artificial sequence
  synthetic sequence
tgatagtgaggagg

SEQ ID NO: 3129 - DNA, 14 bp, Artificial sequence
  synthetic sequence
gtactgccggtgca

SEQ ID NO: 3130 - DNA, 14 bp, Artificial sequence
  synthetic sequence
gagatttagcaagc

SEQ ID NO: 3131 - DNA, 14 bp, Artificial sequence
  synthetic sequence
taaccacgtaaact

SEQ ID NO: 3132 - DNA, 14 bp, Artificial sequence
  synthetic sequence
ggtccccgatgcgt

SEQ ID NO: 3133 - DNA, 14 bp, Artificial sequence
  synthetic sequence
gtgaggagattacc

SEQ ID NO: 3134 - DNA, 14 bp, Artificial sequence
  synthetic sequence
gctttagggacaaa

SEQ ID NO: 3135 - DNA, 14 bp, Artificial sequence
  synthetic sequence
ctcaaaggtaaggt

SEQ ID NO: 3136 - DNA, 14 bp, Artificial sequence
  synthetic sequence
gggactagtgggtc

SEQ ID NO: 3137 - DNA, 14 bp, Artificial sequence
  synthetic sequence
gaggctcgtaagat

SEQ ID NO: 3138 - DNA, 14 bp, Artificial sequence
  synthetic sequence
tgggctgcgggagt

SEQ ID NO: 3139 - DNA, 14 bp, Artificial sequence
  synthetic sequence
cctgtacgacctac

SEQ ID NO: 3140 - DNA, 14 bp, Artificial sequence
  synthetic sequence
cctcggacatggtg

SEQ ID NO: 3141 - DNA, 14 bp, Artificial sequence
  synthetic sequence
cttactgaaacgag

SEQ ID NO: 3142 - DNA, 14 bp, Artificial sequence
  synthetic sequence
gctgggactagtac

SEQ ID NO: 3143 - DNA, 14 bp, Artificial sequence
  synthetic sequence
ctccatcactccgg

SEQ ID NO: 3144 - DNA, 14 bp, Artificial sequence
  synthetic sequence
gtgggagtataagg

SEQ ID NO: 3145 - DNA, 14 bp, Artificial sequence
  synthetic sequence
aaagcgtaggtcat

SEQ ID NO: 3146 - DNA, 14 bp, Artificial sequence
  synthetic sequence
taaagtgggaccat

SEQ ID NO: 3147 - DNA, 14 bp, Artificial sequence
  synthetic sequence
cgactctaggggat

SEQ ID NO: 3148 - DNA, 14 bp, Artificial sequence
  synthetic sequence
acggctctatgacc

SEQ ID NO: 3149 - DNA, 14 bp, Artificial sequence
  synthetic sequence
ttcgcctccccggc

SEQ ID NO: 3150 - DNA, 14 bp, Artificial sequence
  synthetic sequence
actcctagcgataa

SEQ ID NO: 3151 - DNA, 14 bp, Artificial sequence
  synthetic sequence
ctgtcgacccctac

SEQ ID NO: 3152 - DNA, 14 bp, Artificial sequence
  synthetic sequence
ccatggatcgagct

SEQ ID NO: 3153 - DNA, 14 bp, Artificial sequence
  synthetic sequence
ggcgtgctcaaaat

SEQ ID NO: 3154 - DNA, 14 bp, Artificial sequence
  synthetic sequence
cggcatgatccctg

SEQ ID NO: 3155 - DNA, 14 bp, Artificial sequence
  synthetic sequence
tgaatagcggtaag

SEQ ID NO: 3156 - DNA, 14 bp, Artificial sequence
  synthetic sequence
cattgaggcaaggt

SEQ ID NO: 3157 - DNA, 14 bp, Artificial sequence
  synthetic sequence
acattcgagcggta

SEQ ID NO: 3158 - DNA, 14 bp, Artificial sequence
  synthetic sequence
atagcaggataact

SEQ ID NO: 3159 - DNA, 14 bp, Artificial sequence
  synthetic sequence
gacagacacctttg

SEQ ID NO: 3160 - DNA, 14 bp, Artificial sequence
  synthetic sequence
attgcagtaaaaaa

SEQ ID NO: 3161 - DNA, 14 bp, Artificial sequence
  synthetic sequence
cgcatcttgagccc

SEQ ID NO: 3162 - DNA, 14 bp, Artificial sequence
  synthetic sequence
ctatgcagctacca

SEQ ID NO: 3163 - DNA, 14 bp, Artificial sequence
  synthetic sequence
gtagtgctcagcgc

SEQ ID NO: 3164 - DNA, 14 bp, Artificial sequence
  synthetic sequence
aaacgaggtatgtg

SEQ ID NO: 3165 - DNA, 14 bp, Artificial sequence
  synthetic sequence
aaagaggggtgttg

SEQ ID NO: 3166 - DNA, 14 bp, Artificial sequence
  synthetic sequence
acctttgcgggggc

SEQ ID NO: 3167 - DNA, 14 bp, Artificial sequence
  synthetic sequence
attgcacgacatga

SEQ ID NO: 3168 - DNA, 14 bp, Artificial sequence
  synthetic sequence
cttggccatcgagg

SEQ ID NO: 3169 - DNA, 14 bp, Artificial sequence
  synthetic sequence
accttaactaccag

SEQ ID NO: 3170 - DNA, 14 bp, Artificial sequence
  synthetic sequence
cctgaattccagac

SEQ ID NO: 3171 - DNA, 14 bp, Artificial sequence
  synthetic sequence
gtatgacataaaac

SEQ ID NO: 3172 - DNA, 14 bp, Artificial sequence
  synthetic sequence
gatagtaacccgtc

SEQ ID NO: 3173 - DNA, 14 bp, Artificial sequence
  synthetic sequence
accctgagcttccg

SEQ ID NO: 3174 - DNA, 14 bp, Artificial sequence
  synthetic sequence
cacgaatgattcgg

SEQ ID NO: 3175 - DNA, 14 bp, Artificial sequence
  synthetic sequence
cacttcctcccggg

SEQ ID NO: 3176 - DNA, 14 bp, Artificial sequence
  synthetic sequence
agacctgggtggtc

SEQ ID NO: 3177 - DNA, 14 bp, Artificial sequence
  synthetic sequence
taaactcgggctcc

SEQ ID NO: 3178 - DNA, 14 bp, Artificial sequence
  synthetic sequence
catcgcgagcttcc

SEQ ID NO: 3179 - DNA, 14 bp, Artificial sequence
  synthetic sequence
cagaatggaccctt

SEQ ID NO: 3180 - DNA, 14 bp, Artificial sequence
  synthetic sequence
cagaatagcttcaa

SEQ ID NO: 3181 - DNA, 14 bp, Artificial sequence
  synthetic sequence
ttcgaccgcgtaag

SEQ ID NO: 3182 - DNA, 14 bp, Artificial sequence
  synthetic sequence
aggtgagcgtgatg

SEQ ID NO: 3183 - DNA, 14 bp, Artificial sequence
  synthetic sequence
aagccatgcccgtt

SEQ ID NO: 3184 - DNA, 14 bp, Artificial sequence
  synthetic sequence
tacctcgtgcccga

SEQ ID NO: 3185 - DNA, 14 bp, Artificial sequence
  synthetic sequence
acagctaaatagtc

SEQ ID NO: 3186 - DNA, 14 bp, Artificial sequence
  synthetic sequence
ggatcgaatatcgg

SEQ ID NO: 3187 - DNA, 14 bp, Artificial sequence
  synthetic sequence
agttactgggacga

SEQ ID NO: 3188 - DNA, 14 bp, Artificial sequence
  synthetic sequence
atcatcagagtaga

SEQ ID NO: 3189 - DNA, 14 bp, Artificial sequence
  synthetic sequence
ggaaaaatcagtgt

SEQ ID NO: 3190 - DNA, 14 bp, Artificial sequence
  synthetic sequence
ggtcccagcctcat

SEQ ID NO: 3191 - DNA, 14 bp, Artificial sequence
  synthetic sequence
aactgttaacgacc

SEQ ID NO: 3192 - DNA, 14 bp, Artificial sequence
  synthetic sequence
tgaaaagtcgacgt

SEQ ID NO: 3193 - DNA, 14 bp, Artificial sequence
  synthetic sequence
caaacttgaatcca

SEQ ID NO: 3194 - DNA, 14 bp, Artificial sequence
  synthetic sequence
gcttcgccagtagg

SEQ ID NO: 3195 - DNA, 14 bp, Artificial sequence
  synthetic sequence
gtggcctcgcctaa

SEQ ID NO: 3196 - DNA, 14 bp, Artificial sequence
  synthetic sequence
aagtgtccgcgtga

SEQ ID NO: 3197 - DNA, 14 bp, Artificial sequence
  synthetic sequence
tcaccgccaatagt

SEQ ID NO: 3198 - DNA, 14 bp, Artificial sequence
  synthetic sequence
attacgacgcatgg

SEQ ID NO: 3199 - DNA, 14 bp, Artificial sequence
  synthetic sequence
gccacactaatggt

SEQ ID NO: 3200 - DNA, 14 bp, Artificial sequence
  synthetic sequence
aatctcggtgccgg

SEQ ID NO: 3201 - DNA, 14 bp, Artificial sequence
  synthetic sequence
aaatatgcaggtcg

SEQ ID NO: 3202 - DNA, 14 bp, Artificial sequence
  synthetic sequence
atgaaatagatggg

SEQ ID NO: 3203 - DNA, 14 bp, Artificial sequence
  synthetic sequence
tgccgagaccattc

SEQ ID NO: 3204 - DNA, 14 bp, Artificial sequence
  synthetic sequence
caattcagaagtaa

SEQ ID NO: 3205 - DNA, 14 bp, Artificial sequence
  synthetic sequence
gacgttctgaggcg

SEQ ID NO: 3206 - DNA, 14 bp, Artificial sequence
  synthetic sequence
aatagccttaggcc

SEQ ID NO: 3207 - DNA, 14 bp, Artificial sequence
  synthetic sequence
gcgcacataggtgt

SEQ ID NO: 3208 - DNA, 14 bp, Artificial sequence
  synthetic sequence
gccctgattgggga

SEQ ID NO: 3209 - DNA, 14 bp, Artificial sequence
  synthetic sequence
agttccgtggccac

SEQ ID NO: 3210 - DNA, 14 bp, Artificial sequence
  synthetic sequence
aaaccagtttccga

SEQ ID NO: 3211 - DNA, 14 bp, Artificial sequence
  synthetic sequence
agtcgcgttacaca

SEQ ID NO: 3212 - DNA, 14 bp, Artificial sequence
  synthetic sequence
cgtcgggaggtgtc

SEQ ID NO: 3213 - DNA, 14 bp, Artificial sequence
  synthetic sequence
tgataaaccctgca

SEQ ID NO: 3214 - DNA, 14 bp, Artificial sequence
  synthetic sequence
actgcaagcttagg

SEQ ID NO: 3215 - DNA, 14 bp, Artificial sequence
  synthetic sequence
caaatagcatataa

SEQ ID NO: 3216 - DNA, 14 bp, Artificial sequence
  synthetic sequence
ctggccgtacctga

SEQ ID NO: 3217 - DNA, 14 bp, Artificial sequence
  synthetic sequence
gatattgacgggac

SEQ ID NO: 3218 - DNA, 14 bp, Artificial sequence
  synthetic sequence
gatatcaaaagtgc

SEQ ID NO: 3219 - DNA, 14 bp, Artificial sequence
  synthetic sequence
ccctaattcgcccg

SEQ ID NO: 3220 - DNA, 14 bp, Artificial sequence
  synthetic sequence
ggatatggaaaata

SEQ ID NO: 3221 - DNA, 14 bp, Artificial sequence
  synthetic sequence
agcgcctacctact

SEQ ID NO: 3222 - DNA, 14 bp, Artificial sequence
  synthetic sequence
ttgaagcatgggga

SEQ ID NO: 3223 - DNA, 14 bp, Artificial sequence
  synthetic sequence
ctaacagttacaaa

SEQ ID NO: 3224 - DNA, 14 bp, Artificial sequence
  synthetic sequence
actacactaaaatg

SEQ ID NO: 3225 - DNA, 14 bp, Artificial sequence
  synthetic sequence
gtggacagtcctga

SEQ ID NO: 3226 - DNA, 14 bp, Artificial sequence
  synthetic sequence
ttagtcagaccgcc

SEQ ID NO: 3227 - DNA, 14 bp, Artificial sequence
  synthetic sequence
cagaattagacata

SEQ ID NO: 3228 - DNA, 14 bp, Artificial sequence
  synthetic sequence
cactctggagggta

SEQ ID NO: 3229 - DNA, 14 bp, Artificial sequence
  synthetic sequence
aactgaggcttggg

SEQ ID NO: 3230 - DNA, 14 bp, Artificial sequence
  synthetic sequence
aataatggaacatg

SEQ ID NO: 3231 - DNA, 14 bp, Artificial sequence
  synthetic sequence
tagaggtagagatg

SEQ ID NO: 3232 - DNA, 14 bp, Artificial sequence
  synthetic sequence
acctcgactgaaat

SEQ ID NO: 3233 - DNA, 14 bp, Artificial sequence
  synthetic sequence
attaggatcgaccc

SEQ ID NO: 3234 - DNA, 14 bp, Artificial sequence
  synthetic sequence
cacttgcacgggct

SEQ ID NO: 3235 - DNA, 14 bp, Artificial sequence
  synthetic sequence
attgagaggtacca

SEQ ID NO: 3236 - DNA, 14 bp, Artificial sequence
  synthetic sequence
gatagatagacagt

SEQ ID NO: 3237 - DNA, 14 bp, Artificial sequence
  synthetic sequence
gaagcatgggcatt

SEQ ID NO: 3238 - DNA, 14 bp, Artificial sequence
  synthetic sequence
gcaaatcactcctg

SEQ ID NO: 3239 - DNA, 14 bp, Artificial sequence
  synthetic sequence
tgcgtccaggctgc

SEQ ID NO: 3240 - DNA, 14 bp, Artificial sequence
  synthetic sequence
aggtcgacgccatt

SEQ ID NO: 3241 - DNA, 14 bp, Artificial sequence
  synthetic sequence
tggaggcaagtgtc

SEQ ID NO: 3242 - DNA, 14 bp, Artificial sequence
  synthetic sequence
aaccccgattagtg

SEQ ID NO: 3243 - DNA, 14 bp, Artificial sequence
  synthetic sequence
ttgccatgcgacac

SEQ ID NO: 3244 - DNA, 14 bp, Artificial sequence
  synthetic sequence
atataaagcactaa

SEQ ID NO: 3245 - DNA, 14 bp, Artificial sequence
  synthetic sequence
ggcataatagaact

SEQ ID NO: 3246 - DNA, 14 bp, Artificial sequence
  synthetic sequence
gttagcggctccgc

SEQ ID NO: 3247 - DNA, 14 bp, Artificial sequence
  synthetic sequence
ctacccctaaggtg

SEQ ID NO: 3248 - DNA, 14 bp, Artificial sequence
  synthetic sequence
gtatgacaagtaga

SEQ ID NO: 3249 - DNA, 14 bp, Artificial sequence
  synthetic sequence
tacctggcgctccc

SEQ ID NO: 3250 - DNA, 14 bp, Artificial sequence
  synthetic sequence
tcgcccagcggatt

SEQ ID NO: 3251 - DNA, 14 bp, Artificial sequence
  synthetic sequence
agcgcagattgtgg

SEQ ID NO: 3252 - DNA, 14 bp, Artificial sequence
  synthetic sequence
catgcatctgacaa

SEQ ID NO: 3253 - DNA, 14 bp, Artificial sequence
  synthetic sequence
tgctaacctacccg

SEQ ID NO: 3254 - DNA, 14 bp, Artificial sequence
  synthetic sequence
ctactgtagaggga

SEQ ID NO: 3255 - DNA, 14 bp, Artificial sequence
  synthetic sequence
agtgagaacaggtt

SEQ ID NO: 3256 - DNA, 14 bp, Artificial sequence
  synthetic sequence
taagagaactctca

SEQ ID NO: 3257 - DNA, 14 bp, Artificial sequence
  synthetic sequence
tgctcgaaggatag

SEQ ID NO: 3258 - DNA, 14 bp, Artificial sequence
  synthetic sequence
aagaaaagaacttt

SEQ ID NO: 3259 - DNA, 14 bp, Artificial sequence
  synthetic sequence
ttcgccctagccca

SEQ ID NO: 3260 - DNA, 14 bp, Artificial sequence
  synthetic sequence
cggatcatcacagt

SEQ ID NO: 3261 - DNA, 14 bp, Artificial sequence
  synthetic sequence
aagccgattggata

SEQ ID NO: 3262 - DNA, 14 bp, Artificial sequence
  synthetic sequence
agattcaacgtaac

SEQ ID NO: 3263 - DNA, 14 bp, Artificial sequence
  synthetic sequence
acaagagcttaggt

SEQ ID NO: 3264 - DNA, 14 bp, Artificial sequence
  synthetic sequence
tccggcattccgga

SEQ ID NO: 3265 - DNA, 14 bp, Artificial sequence
  synthetic sequence
gtcctcagcctccc

SEQ ID NO: 3266 - DNA, 14 bp, Artificial sequence
  synthetic sequence
atcgtccgacatcc

SEQ ID NO: 3267 - DNA, 14 bp, Artificial sequence
  synthetic sequence
acgcctatatgcga

SEQ ID NO: 3268 - DNA, 14 bp, Artificial sequence
  synthetic sequence
atcgcacgctgctc

SEQ ID NO: 3269 - DNA, 14 bp, Artificial sequence
  synthetic sequence
tcattgggaatggc

SEQ ID NO: 3270 - DNA, 14 bp, Artificial sequence
  synthetic sequence
ccttacgcatcgtc

SEQ ID NO: 3271 - DNA, 14 bp, Artificial sequence
  synthetic sequence
acgggttgagatgt

SEQ ID NO: 3272 - DNA, 14 bp, Artificial sequence
  synthetic sequence
agaatgagggcttt

SEQ ID NO: 3273 - DNA, 14 bp, Artificial sequence
  synthetic sequence
gctcaatcttgggc

SEQ ID NO: 3274 - DNA, 14 bp, Artificial sequence
  synthetic sequence
gtatgcctagcatg

SEQ ID NO: 3275 - DNA, 14 bp, Artificial sequence
  synthetic sequence
tcaagtcttgccaa

SEQ ID NO: 3276 - DNA, 14 bp, Artificial sequence
  synthetic sequence
aatataccgtcagt

SEQ ID NO: 3277 - DNA, 14 bp, Artificial sequence
  synthetic sequence
tcaacgtctctccc

SEQ ID NO: 3278 - DNA, 14 bp, Artificial sequence
  synthetic sequence
atcgttgatccggg

SEQ ID NO: 3279 - DNA, 14 bp, Artificial sequence
  synthetic sequence
gtgtatgacaggct

SEQ ID NO: 3280 - DNA, 14 bp, Artificial sequence
  synthetic sequence
tttgcaacgtgcac

SEQ ID NO: 3281 - DNA, 14 bp, Artificial sequence
  synthetic sequence
acctctggcactta

SEQ ID NO: 3282 - DNA, 14 bp, Artificial sequence
  synthetic sequence
gctaaggatgaatt

SEQ ID NO: 3283 - DNA, 14 bp, Artificial sequence
  synthetic sequence
gcgtctctcaatag

SEQ ID NO: 3284 - DNA, 14 bp, Artificial sequence
  synthetic sequence
gccaatatgtcact

SEQ ID NO: 3285 - DNA, 14 bp, Artificial sequence
  synthetic sequence
tgtaggggactcct

SEQ ID NO: 3286 - DNA, 14 bp, Artificial sequence
  synthetic sequence
actcaatctagact

SEQ ID NO: 3287 - DNA, 14 bp, Artificial sequence
  synthetic sequence
aggtaatctcactc

SEQ ID NO: 3288 - DNA, 14 bp, Artificial sequence
  synthetic sequence
gtgcgttaggatcg

SEQ ID NO: 3289 - DNA, 14 bp, Artificial sequence
  synthetic sequence
atcagagccgttat

SEQ ID NO: 3290 - DNA, 14 bp, Artificial sequence
  synthetic sequence
atcgctccgccgtt

SEQ ID NO: 3291 - DNA, 14 bp, Artificial sequence
  synthetic sequence
tacggggatacgtt

SEQ ID NO: 3292 - DNA, 14 bp, Artificial sequence
  synthetic sequence
gatcaactattcgc

SEQ ID NO: 3293 - DNA, 14 bp, Artificial sequence
  synthetic sequence
tcaagtgtatgaaa

SEQ ID NO: 3294 - DNA, 14 bp, Artificial sequence
  synthetic sequence
ctcccgagtcctgt

SEQ ID NO: 3295 - DNA, 14 bp, Artificial sequence
  synthetic sequence
atgctggtgccagt

SEQ ID NO: 3296 - DNA, 14 bp, Artificial sequence
  synthetic sequence
atagtgcaagattg

SEQ ID NO: 3297 - DNA, 14 bp, Artificial sequence
  synthetic sequence
ataggcgtctaggt

SEQ ID NO: 3298 - DNA, 14 bp, Artificial sequence
  synthetic sequence
taaaatacctctgg

SEQ ID NO: 3299 - DNA, 14 bp, Artificial sequence
  synthetic sequence
gctcccatcatctg

SEQ ID NO: 3300 - DNA, 14 bp, Artificial sequence
  synthetic sequence
gcaactgaatatgt

SEQ ID NO: 3301 - DNA, 14 bp, Artificial sequence
  synthetic sequence
gcgctttgcgaata

SEQ ID NO: 3302 - DNA, 14 bp, Artificial sequence
  synthetic sequence
cttagcggagtact

SEQ ID NO: 3303 - DNA, 14 bp, Artificial sequence
  synthetic sequence
tagccggtactagt

SEQ ID NO: 3304 - DNA, 14 bp, Artificial sequence
  synthetic sequence
cgttaagttccgcg

SEQ ID NO: 3305 - DNA, 14 bp, Artificial sequence
  synthetic sequence
ctatctggctcaga

SEQ ID NO: 3306 - DNA, 14 bp, Artificial sequence
  synthetic sequence
aggattggaattgg

SEQ ID NO: 3307 - DNA, 14 bp, Artificial sequence
  synthetic sequence
gatctacgtaatgc

SEQ ID NO: 3308 - DNA, 14 bp, Artificial sequence
  synthetic sequence
tcgtccgaggtgta

SEQ ID NO: 3309 - DNA, 14 bp, Artificial sequence
  synthetic sequence
cgttgtctagaacg

SEQ ID NO: 3310 - DNA, 14 bp, Artificial sequence
  synthetic sequence
gctgatcgcgttaa

SEQ ID NO: 3311 - DNA, 14 bp, Artificial sequence
  synthetic sequence
tcgggattgcggta

SEQ ID NO: 3312 - DNA, 14 bp, Artificial sequence
  synthetic sequence
tgggcgaacggttt

SEQ ID NO: 3313 - DNA, 14 bp, Artificial sequence
  synthetic sequence
taaccttcagtgaa

SEQ ID NO: 3314 - DNA, 14 bp, Artificial sequence
  synthetic sequence
gacataccttgaat

SEQ ID NO: 3315 - DNA, 14 bp, Artificial sequence
  synthetic sequence
aagaaatttcacgt

SEQ ID NO: 3316 - DNA, 14 bp, Artificial sequence
  synthetic sequence
accctaggtactat

SEQ ID NO: 3317 - DNA, 14 bp, Artificial sequence
  synthetic sequence
tacgcataggtgta

SEQ ID NO: 3318 - DNA, 14 bp, Artificial sequence
  synthetic sequence
atcggggttctaac

SEQ ID NO: 3319 - DNA, 14 bp, Artificial sequence
  synthetic sequence
gagtgctgcgggtt

SEQ ID NO: 3320 - DNA, 14 bp, Artificial sequence
  synthetic sequence
cctccctccgaatt

SEQ ID NO: 3321 - DNA, 14 bp, Artificial sequence
  synthetic sequence
tgccctgcgttgaa

SEQ ID NO: 3322 - DNA, 14 bp, Artificial sequence
  synthetic sequence
agcgtgccatctat

SEQ ID NO: 3323 - DNA, 14 bp, Artificial sequence
  synthetic sequence
tagctcaggtgagt

SEQ ID NO: 3324 - DNA, 14 bp, Artificial sequence
  synthetic sequence
gaccctttcgcgta

SEQ ID NO: 3325 - DNA, 14 bp, Artificial sequence
  synthetic sequence
tttaaggtcgagac

SEQ ID NO: 3326 - DNA, 14 bp, Artificial sequence
  synthetic sequence
ctcgggcttacgtc

SEQ ID NO: 3327 - DNA, 14 bp, Artificial sequence
  synthetic sequence
agtgggatgtgtac

SEQ ID NO: 3328 - DNA, 14 bp, Artificial sequence
  synthetic sequence
gctatgtcagcggt

SEQ ID NO: 3329 - DNA, 14 bp, Artificial sequence
  synthetic sequence
accggtaattccct

SEQ ID NO: 3330 - DNA, 14 bp, Artificial sequence
  synthetic sequence
cgtccacttgggat

SEQ ID NO: 3331 - DNA, 14 bp, Artificial sequence
  synthetic sequence
catcagtacctcta

SEQ ID NO: 3332 - DNA, 14 bp, Artificial sequence
  synthetic sequence
ttagacgatatgga

SEQ ID NO: 3333 - DNA, 14 bp, Artificial sequence
  synthetic sequence
ctgcgctatatggc

SEQ ID NO: 3334 - DNA, 14 bp, Artificial sequence
  synthetic sequence
gtggttggaaacat

SEQ ID NO: 3335 - DNA, 14 bp, Artificial sequence
  synthetic sequence
tacctgcgctacta

SEQ ID NO: 3336 - DNA, 14 bp, Artificial sequence
  synthetic sequence
ttataccagccctc

SEQ ID NO: 3337 - DNA, 14 bp, Artificial sequence
  synthetic sequence
ctgctcctggaatg

SEQ ID NO: 3338 - DNA, 14 bp, Artificial sequence
  synthetic sequence
tcactgtgcgtcaa

SEQ ID NO: 3339 - DNA, 14 bp, Artificial sequence
  synthetic sequence
tgtgaacaaaactt

SEQ ID NO: 3340 - DNA, 14 bp, Artificial sequence
  synthetic sequence
ggtgtgccgtcgtc

SEQ ID NO: 3341 - DNA, 14 bp, Artificial sequence
  synthetic sequence
ccttccaatataac

SEQ ID NO: 3342 - DNA, 14 bp, Artificial sequence
  synthetic sequence
tgttgatgcagcac

SEQ ID NO: 3343 - DNA, 14 bp, Artificial sequence
  synthetic sequence
tcttagaatcagac

SEQ ID NO: 3344 - DNA, 14 bp, Artificial sequence
  synthetic sequence
gacacttaatccgt

SEQ ID NO: 3345 - DNA, 14 bp, Artificial sequence
  synthetic sequence
tatgtaggtagcgc

SEQ ID NO: 3346 - DNA, 14 bp, Artificial sequence
  synthetic sequence
tactccgccaattg

SEQ ID NO: 3347 - DNA, 14 bp, Artificial sequence
  synthetic sequence
gcgggttctgtcgg

SEQ ID NO: 3348 - DNA, 14 bp, Artificial sequence
  synthetic sequence
attacaccatgcgt

SEQ ID NO: 3349 - DNA, 14 bp, Artificial sequence
  synthetic sequence
ttggcagacgttcc

SEQ ID NO: 3350 - DNA, 14 bp, Artificial sequence
  synthetic sequence
actgcgtcctcctc

SEQ ID NO: 3351 - DNA, 14 bp, Artificial sequence
  synthetic sequence
atcctcgaatctac

SEQ ID NO: 3352 - DNA, 14 bp, Artificial sequence
  synthetic sequence
acaattgtggcgtc

SEQ ID NO: 3353 - DNA, 14 bp, Artificial sequence
  synthetic sequence
ggtctagtaccatc

SEQ ID NO: 3354 - DNA, 14 bp, Artificial sequence
  synthetic sequence
agaatttagtcaac

SEQ ID NO: 3355 - DNA, 14 bp, Artificial sequence
  synthetic sequence
aaggtagatgtcct

SEQ ID NO: 3356 - DNA, 14 bp, Artificial sequence
  synthetic sequence
tactcgctctagag

SEQ ID NO: 3357 - DNA, 14 bp, Artificial sequence
  synthetic sequence
tattcacggctccc

SEQ ID NO: 3358 - DNA, 14 bp, Artificial sequence
  synthetic sequence
tcgggtcgaatggt

SEQ ID NO: 3359 - DNA, 14 bp, Artificial sequence
  synthetic sequence
gagtgagtgtacct

SEQ ID NO: 3360 - DNA, 14 bp, Artificial sequence
  synthetic sequence
agtgtagctaatcg

SEQ ID NO: 3361 - DNA, 14 bp, Artificial sequence
  synthetic sequence
gtgaccttaataag

SEQ ID NO: 3362 - DNA, 14 bp, Artificial sequence
  synthetic sequence
tattgcacggaaat

SEQ ID NO: 3363 - DNA, 14 bp, Artificial sequence
  synthetic sequence
ggtttgccaatccg

SEQ ID NO: 3364 - DNA, 14 bp, Artificial sequence
  synthetic sequence
cagtcgttccgcct

SEQ ID NO: 3365 - DNA, 14 bp, Artificial sequence
  synthetic sequence
gactggactgtgtc

SEQ ID NO: 3366 - DNA, 14 bp, Artificial sequence
  synthetic sequence
accattttgaccaa

SEQ ID NO: 3367 - DNA, 14 bp, Artificial sequence
  synthetic sequence
cagtgcaagttcta

SEQ ID NO: 3368 - DNA, 14 bp, Artificial sequence
  synthetic sequence
gccaaatttgataa

SEQ ID NO: 3369 - DNA, 14 bp, Artificial sequence
  synthetic sequence
tgacgggttggtgg

SEQ ID NO: 3370 - DNA, 14 bp, Artificial sequence
  synthetic sequence
aactccattatcgc

SEQ ID NO: 3371 - DNA, 14 bp, Artificial sequence
  synthetic sequence
ggttggtaagtgcc

SEQ ID NO: 3372 - DNA, 14 bp, Artificial sequence
  synthetic sequence
accaatgagtcgtt

SEQ ID NO: 3373 - DNA, 14 bp, Artificial sequence
  synthetic sequence
agtctttagcgacc

SEQ ID NO: 3374 - DNA, 14 bp, Artificial sequence
  synthetic sequence
cttgtagaatcgaa

SEQ ID NO: 3375 - DNA, 14 bp, Artificial sequence
  synthetic sequence
taacacgtcatagt

SEQ ID NO: 3376 - DNA, 14 bp, Artificial sequence
  synthetic sequence
cgtagagtgagtta

SEQ ID NO: 3377 - DNA, 14 bp, Artificial sequence
  synthetic sequence
acggtgtccggtct

SEQ ID NO: 3378 - DNA, 14 bp, Artificial sequence
  synthetic sequence
gtcgtggctagata

SEQ ID NO: 3379 - DNA, 14 bp, Artificial sequence
  synthetic sequence
tcatctactgcgag

SEQ ID NO: 3380 - DNA, 14 bp, Artificial sequence
  synthetic sequence
gtgagattctgaca

SEQ ID NO: 3381 - DNA, 14 bp, Artificial sequence
  synthetic sequence
actggcgcttctca

SEQ ID NO: 3382 - DNA, 14 bp, Artificial sequence
  synthetic sequence
ttcccctataggag

SEQ ID NO: 3383 - DNA, 14 bp, Artificial sequence
  synthetic sequence
cctatccacactta

SEQ ID NO: 3384 - DNA, 14 bp, Artificial sequence
  synthetic sequence
tattcgagcaggct

SEQ ID NO: 3385 - DNA, 14 bp, Artificial sequence
  synthetic sequence
cctcaactccctgt

SEQ ID NO: 3386 - DNA, 14 bp, Artificial sequence
  synthetic sequence
aatccgtgaatgtg

SEQ ID NO: 3387 - DNA, 14 bp, Artificial sequence
  synthetic sequence
gaggctgttcgtgc

SEQ ID NO: 3388 - DNA, 14 bp, Artificial sequence
  synthetic sequence
tgcgatattagccc

SEQ ID NO: 3389 - DNA, 14 bp, Artificial sequence
  synthetic sequence
agctaacatttacg

SEQ ID NO: 3390 - DNA, 14 bp, Artificial sequence
  synthetic sequence
tataattacgagcc

SEQ ID NO: 3391 - DNA, 14 bp, Artificial sequence
  synthetic sequence
gctggattgtcaac

SEQ ID NO: 3392 - DNA, 14 bp, Artificial sequence
  synthetic sequence
ctaggcccttcgtg

SEQ ID NO: 3393 - DNA, 14 bp, Artificial sequence
  synthetic sequence
gccgtccatagtgt

SEQ ID NO: 3394 - DNA, 14 bp, Artificial sequence
  synthetic sequence
ctcacaggttctgg

SEQ ID NO: 3395 - DNA, 14 bp, Artificial sequence
  synthetic sequence
ctgcgtttagccgg

SEQ ID NO: 3396 - DNA, 14 bp, Artificial sequence
  synthetic sequence
tagcctgatcgcgt

SEQ ID NO: 3397 - DNA, 14 bp, Artificial sequence
  synthetic sequence
atggtataaggggt

SEQ ID NO: 3398 - DNA, 14 bp, Artificial sequence
  synthetic sequence
cttttgaacgacaa

SEQ ID NO: 3399 - DNA, 14 bp, Artificial sequence
  synthetic sequence
tagtctaaacaagt

SEQ ID NO: 3400 - DNA, 14 bp, Artificial sequence
  synthetic sequence
agtctattcggccg

SEQ ID NO: 3401 - DNA, 14 bp, Artificial sequence
  synthetic sequence
gaactagagtatgt

SEQ ID NO: 3402 - DNA, 14 bp, Artificial sequence
  synthetic sequence
gtatagatcgacta

SEQ ID NO: 3403 - DNA, 14 bp, Artificial sequence
  synthetic sequence
acacttcgttcgca

SEQ ID NO: 3404 - DNA, 14 bp, Artificial sequence
  synthetic sequence
ttggccaaccctct

SEQ ID NO: 3405 - DNA, 14 bp, Artificial sequence
  synthetic sequence
catcagtggcctat

SEQ ID NO: 3406 - DNA, 14 bp, Artificial sequence
  synthetic sequence
tagctgtcagcgct

SEQ ID NO: 3407 - DNA, 14 bp, Artificial sequence
  synthetic sequence
tcaaaaagttctaa

SEQ ID NO: 3408 - DNA, 14 bp, Artificial sequence
  synthetic sequence
atgatctccctccg

SEQ ID NO: 3409 - DNA, 14 bp, Artificial sequence
  synthetic sequence
agcgacgtttgcat

SEQ ID NO: 3410 - DNA, 14 bp, Artificial sequence
  synthetic sequence
ccgtttaagcgcgt

SEQ ID NO: 3411 - DNA, 14 bp, Artificial sequence
  synthetic sequence
ggtgtcacacggtt

SEQ ID NO: 3412 - DNA, 14 bp, Artificial sequence
  synthetic sequence
atgtggtcgtagac

SEQ ID NO: 3413 - DNA, 14 bp, Artificial sequence
  synthetic sequence
ctccgtattgagcg

SEQ ID NO: 3414 - DNA, 14 bp, Artificial sequence
  synthetic sequence
taactctctgccaa

SEQ ID NO: 3415 - DNA, 14 bp, Artificial sequence
  synthetic sequence
acctgttagcacta

SEQ ID NO: 3416 - DNA, 14 bp, Artificial sequence
  synthetic sequence
cagtccctttgcag

SEQ ID NO: 3417 - DNA, 14 bp, Artificial sequence
  synthetic sequence
tgactattgcggac

SEQ ID NO: 3418 - DNA, 14 bp, Artificial sequence
  synthetic sequence
ccgttcgttaacag

SEQ ID NO: 3419 - DNA, 14 bp, Artificial sequence
  synthetic sequence
tactaagttaccga

SEQ ID NO: 3420 - DNA, 14 bp, Artificial sequence
  synthetic sequence
caggatttgcgcgt

SEQ ID NO: 3421 - DNA, 14 bp, Artificial sequence
  synthetic sequence
gcatttgccatgga

SEQ ID NO: 3422 - DNA, 14 bp, Artificial sequence
  synthetic sequence
tgagcatgtacatc

SEQ ID NO: 3423 - DNA, 14 bp, Artificial sequence
  synthetic sequence
ttgcgtatgggcca

SEQ ID NO: 3424 - DNA, 14 bp, Artificial sequence
  synthetic sequence
tactgaagtctgac

SEQ ID NO: 3425 - DNA, 14 bp, Artificial sequence
  synthetic sequence
cgtcctgctcacct

SEQ ID NO: 3426 - DNA, 14 bp, Artificial sequence
  synthetic sequence
tgtctggtgacagg

SEQ ID NO: 3427 - DNA, 14 bp, Artificial sequence
  synthetic sequence
tatggattcaaaac

SEQ ID NO: 3428 - DNA, 14 bp, Artificial sequence
  synthetic sequence
ctgcacaatcgtta

SEQ ID NO: 3429 - DNA, 14 bp, Artificial sequence
  synthetic sequence
cgcaaccttatcgt

SEQ ID NO: 3430 - DNA, 14 bp, Artificial sequence
  synthetic sequence
tcggctataatcgc

SEQ ID NO: 3431 - DNA, 14 bp, Artificial sequence
  synthetic sequence
ctggaaagacgttt

SEQ ID NO: 3432 - DNA, 14 bp, Artificial sequence
  synthetic sequence
atgtatccatcccc

SEQ ID NO: 3433 - DNA, 14 bp, Artificial sequence
  synthetic sequence
catctggtataacc

SEQ ID NO: 3434 - DNA, 14 bp, Artificial sequence
  synthetic sequence
ccatatcatcgact

SEQ ID NO: 3435 - DNA, 14 bp, Artificial sequence
  synthetic sequence
agtctcagctcgct

SEQ ID NO: 3436 - DNA, 14 bp, Artificial sequence
  synthetic sequence
tctactcgaggagt

SEQ ID NO: 3437 - DNA, 14 bp, Artificial sequence
  synthetic sequence
ctccatgaacaatt

SEQ ID NO: 3438 - DNA, 14 bp, Artificial sequence
  synthetic sequence
ccaatcggctctgt

SEQ ID NO: 3439 - DNA, 14 bp, Artificial sequence
  synthetic sequence
gctgtcctatcagc

SEQ ID NO: 3440 - DNA, 14 bp, Artificial sequence
  synthetic sequence
cgatgtcctactgc

SEQ ID NO: 3441 - DNA, 14 bp, Artificial sequence
  synthetic sequence
cgagatgggttact

SEQ ID NO: 3442 - DNA, 14 bp, Artificial sequence
  synthetic sequence
tgttagccgcatag

SEQ ID NO: 3443 - DNA, 14 bp, Artificial sequence
  synthetic sequence
agaatcctgtgatg

SEQ ID NO: 3444 - DNA, 14 bp, Artificial sequence
  synthetic sequence
ttatcgtagaccga

SEQ ID NO: 3445 - DNA, 14 bp, Artificial sequence
  synthetic sequence
ggagcacggatttt

SEQ ID NO: 3446 - DNA, 14 bp, Artificial sequence
  synthetic sequence
cgatagagtgtaat

SEQ ID NO: 3447 - DNA, 14 bp, Artificial sequence
  synthetic sequence
cagcccttgaagtt

SEQ ID NO: 3448 - DNA, 14 bp, Artificial sequence
  synthetic sequence
atggcgacatcttc

SEQ ID NO: 3449 - DNA, 14 bp, Artificial sequence
  synthetic sequence
ctactcgccgttac

SEQ ID NO: 3450 - DNA, 14 bp, Artificial sequence
  synthetic sequence
agaaaatctttcgg

SEQ ID NO: 3451 - DNA, 14 bp, Artificial sequence
  synthetic sequence
gacaatggggtgtt

SEQ ID NO: 3452 - DNA, 14 bp, Artificial sequence
  synthetic sequence
gccttagcctgtag

SEQ ID NO: 3453 - DNA, 14 bp, Artificial sequence
  synthetic sequence
aacggaatttggta

SEQ ID NO: 3454 - DNA, 14 bp, Artificial sequence
  synthetic sequence
tgaactagaactgt

SEQ ID NO: 3455 - DNA, 14 bp, Artificial sequence
  synthetic sequence
acatgtggaatcct

SEQ ID NO: 3456 - DNA, 14 bp, Artificial sequence
  synthetic sequence
tacaggccatcatt

SEQ ID NO: 3457 - DNA, 14 bp, Artificial sequence
  synthetic sequence
ttctctacacgaaa

SEQ ID NO: 3458 - DNA, 14 bp, Artificial sequence
  synthetic sequence
acaaagatttgaat

SEQ ID NO: 3459 - DNA, 14 bp, Artificial sequence
  synthetic sequence
accgttaataaata

SEQ ID NO: 3460 - DNA, 14 bp, Artificial sequence
  synthetic sequence
actgatacttagcc

SEQ ID NO: 3461 - DNA, 14 bp, Artificial sequence
  synthetic sequence
taccctagattcgc

SEQ ID NO: 3462 - DNA, 14 bp, Artificial sequence
  synthetic sequence
ccacgatcctgttg

SEQ ID NO: 3463 - DNA, 14 bp, Artificial sequence
  synthetic sequence
tgccgttcgctcgc

SEQ ID NO: 3464 - DNA, 14 bp, Artificial sequence
  synthetic sequence
attgatatccgggg

SEQ ID NO: 3465 - DNA, 14 bp, Artificial sequence
  synthetic sequence
gagtcgcgtcgtct

SEQ ID NO: 3466 - DNA, 14 bp, Artificial sequence
  synthetic sequence
tagacagttcgctg

SEQ ID NO: 3467 - DNA, 14 bp, Artificial sequence
  synthetic sequence
aatcttagagggta

SEQ ID NO: 3468 - DNA, 14 bp, Artificial sequence
  synthetic sequence
ccttgaagaactgt

SEQ ID NO: 3469 - DNA, 14 bp, Artificial sequence
  synthetic sequence
gtcgtgtgtgagcg

SEQ ID NO: 3470 - DNA, 14 bp, Artificial sequence
  synthetic sequence
ccctggacgtatgt

SEQ ID NO: 3471 - DNA, 14 bp, Artificial sequence
  synthetic sequence
ctacccgctcgatt

SEQ ID NO: 3472 - DNA, 14 bp, Artificial sequence
  synthetic sequence
cgtctgcactatgg

SEQ ID NO: 3473 - DNA, 14 bp, Artificial sequence
  synthetic sequence
agtgtattacaggg

SEQ ID NO: 3474 - DNA, 14 bp, Artificial sequence
  synthetic sequence
atgttaggaagaat

SEQ ID NO: 3475 - DNA, 14 bp, Artificial sequence
  synthetic sequence
taaccttcaaccct

SEQ ID NO: 3476 - DNA, 14 bp, Artificial sequence
  synthetic sequence
gttacgccttaggg

SEQ ID NO: 3477 - DNA, 14 bp, Artificial sequence
  synthetic sequence
tacatttggcgccc

SEQ ID NO: 3478 - DNA, 14 bp, Artificial sequence
  synthetic sequence
actcgactgctcta

SEQ ID NO: 3479 - DNA, 14 bp, Artificial sequence
  synthetic sequence
atatgcttaaacca

SEQ ID NO: 3480 - DNA, 14 bp, Artificial sequence
  synthetic sequence
ttagctgtgagcaa

SEQ ID NO: 3481 - DNA, 14 bp, Artificial sequence
  synthetic sequence
tggacatattaaca

SEQ ID NO: 3482 - DNA, 14 bp, Artificial sequence
  synthetic sequence
ctaccgccattctc

SEQ ID NO: 3483 - DNA, 14 bp, Artificial sequence
  synthetic sequence
atcttgactcgccg

SEQ ID NO: 3484 - DNA, 14 bp, Artificial sequence
  synthetic sequence
taggctgattcagc

SEQ ID NO: 3485 - DNA, 14 bp, Artificial sequence
  synthetic sequence
tttggtgccaaaca

SEQ ID NO: 3486 - DNA, 14 bp, Artificial sequence
  synthetic sequence
cacgatctttccac

SEQ ID NO: 3487 - DNA, 14 bp, Artificial sequence
  synthetic sequence
actatggttcgcgg

SEQ ID NO: 3488 - DNA, 14 bp, Artificial sequence
  synthetic sequence
gtctcctgatggaa

SEQ ID NO: 3489 - DNA, 14 bp, Artificial sequence
  synthetic sequence
caattgtgcaggta

SEQ ID NO: 3490 - DNA, 14 bp, Artificial sequence
  synthetic sequence
tacggcgtgattgc

SEQ ID NO: 3491 - DNA, 14 bp, Artificial sequence
  synthetic sequence
gagattcgtctggg

SEQ ID NO: 3492 - DNA, 14 bp, Artificial sequence
  synthetic sequence
cggttaatgcctaa

SEQ ID NO: 3493 - DNA, 14 bp, Artificial sequence
  synthetic sequence
gaacgctatcgttc

SEQ ID NO: 3494 - DNA, 14 bp, Artificial sequence
  synthetic sequence
ctccttctgcgagg

SEQ ID NO: 3495 - DNA, 14 bp, Artificial sequence
  synthetic sequence
ctgtgcatgaatcc

SEQ ID NO: 3496 - DNA, 14 bp, Artificial sequence
  synthetic sequence
caatcttctaggag

SEQ ID NO: 3497 - DNA, 14 bp, Artificial sequence
  synthetic sequence
gctggcactacatt

SEQ ID NO: 3498 - DNA, 14 bp, Artificial sequence
  synthetic sequence
ttagcgctcgcctc

SEQ ID NO: 3499 - DNA, 14 bp, Artificial sequence
  synthetic sequence
tgggggtgtcctag

SEQ ID NO: 3500 - DNA, 14 bp, Artificial sequence
  synthetic sequence
ggccttacggtgtc

SEQ ID NO: 3501 - DNA, 14 bp, Artificial sequence
  synthetic sequence
gtgtggagtccggt

SEQ ID NO: 3502 - DNA, 14 bp, Artificial sequence
  synthetic sequence
tgtaatgcgtcgca

SEQ ID NO: 3503 - DNA, 14 bp, Artificial sequence
  synthetic sequence
ctgagtgacatgat

SEQ ID NO: 3504 - DNA, 14 bp, Artificial sequence
  synthetic sequence
ccttaatccgataa

SEQ ID NO: 3505 - DNA, 14 bp, Artificial sequence
  synthetic sequence
atcttaaacccgtg

SEQ ID NO: 3506 - DNA, 14 bp, Artificial sequence
  synthetic sequence
tcactcggtgagtc

SEQ ID NO: 3507 - DNA, 14 bp, Artificial sequence
  synthetic sequence
tcacaacagctttc

SEQ ID NO: 3508 - DNA, 14 bp, Artificial sequence
  synthetic sequence
atcctctgaaaatg

SEQ ID NO: 3509 - DNA, 14 bp, Artificial sequence
  synthetic sequence
cgcggtccttcgat

SEQ ID NO: 3510 - DNA, 14 bp, Artificial sequence
  synthetic sequence
cattaccttggacg

SEQ ID NO: 3511 - DNA, 14 bp, Artificial sequence
  synthetic sequence
cccgtgcttactga

SEQ ID NO: 3512 - DNA, 14 bp, Artificial sequence
  synthetic sequence
cgccacattagtct

SEQ ID NO: 3513 - DNA, 14 bp, Artificial sequence
  synthetic sequence
cctgcaggcttctc

SEQ ID NO: 3514 - DNA, 14 bp, Artificial sequence
  synthetic sequence
catgtgctacataa

SEQ ID NO: 3515 - DNA, 14 bp, Artificial sequence
  synthetic sequence
aactaactgtatcg

SEQ ID NO: 3516 - DNA, 14 bp, Artificial sequence
  synthetic sequence
ccccacttaatctg

SEQ ID NO: 3517 - DNA, 14 bp, Artificial sequence
  synthetic sequence
catgattcgactac

SEQ ID NO: 3518 - DNA, 14 bp, Artificial sequence
  synthetic sequence
cattgagagttcag

SEQ ID NO: 3519 - DNA, 14 bp, Artificial sequence
  synthetic sequence
atcagcatgcttca

SEQ ID NO: 3520 - DNA, 14 bp, Artificial sequence
  synthetic sequence
tgttaaagatcccg

SEQ ID NO: 3521 - DNA, 14 bp, Artificial sequence
  synthetic sequence
atgctccggagatt

SEQ ID NO: 3522 - DNA, 14 bp, Artificial sequence
  synthetic sequence
cagaaactattgtc

SEQ ID NO: 3523 - DNA, 14 bp, Artificial sequence
  synthetic sequence
caattcatggtagg

SEQ ID NO: 3524 - DNA, 14 bp, Artificial sequence
  synthetic sequence
cactttggcatgcc

SEQ ID NO: 3525 - DNA, 14 bp, Artificial sequence
  synthetic sequence
accctcgttaagta

SEQ ID NO: 3526 - DNA, 14 bp, Artificial sequence
  synthetic sequence
tcaattaagtgaca

SEQ ID NO: 3527 - DNA, 14 bp, Artificial sequence
  synthetic sequence
cacaaattttcggc

SEQ ID NO: 3528 - DNA, 14 bp, Artificial sequence
  synthetic sequence
aacaacgtttctgg

SEQ ID NO: 3529 - DNA, 14 bp, Artificial sequence
  synthetic sequence
ccatgtgttgagga

SEQ ID NO: 3530 - DNA, 14 bp, Artificial sequence
  synthetic sequence
cagcatttcacaat

SEQ ID NO: 3531 - DNA, 14 bp, Artificial sequence
  synthetic sequence
tagcagatttacga

SEQ ID NO: 3532 - DNA, 14 bp, Artificial sequence
  synthetic sequence
ggtaaattatcagg

SEQ ID NO: 3533 - DNA, 14 bp, Artificial sequence
  synthetic sequence
aggctgctgttcgc

SEQ ID NO: 3534 - DNA, 14 bp, Artificial sequence
  synthetic sequence
ggtatagcccgatt

SEQ ID NO: 3535 - DNA, 14 bp, Artificial sequence
  synthetic sequence
aagttagaggtatg

SEQ ID NO: 3536 - DNA, 14 bp, Artificial sequence
  synthetic sequence
agacaaatgtcttc

SEQ ID NO: 3537 - DNA, 14 bp, Artificial sequence
  synthetic sequence
gtgcaatctagctc

SEQ ID NO: 3538 - DNA, 14 bp, Artificial sequence
  synthetic sequence
tcgtagccgattac

SEQ ID NO: 3539 - DNA, 14 bp, Artificial sequence
  synthetic sequence
tacgcatcttaccg

SEQ ID NO: 3540 - DNA, 14 bp, Artificial sequence
  synthetic sequence
agtgggtcggtata

SEQ ID NO: 3541 - DNA, 14 bp, Artificial sequence
  synthetic sequence
atcgcggtggtatg

SEQ ID NO: 3542 - DNA, 14 bp, Artificial sequence
  synthetic sequence
tgggtgctccggct

SEQ ID NO: 3543 - DNA, 14 bp, Artificial sequence
  synthetic sequence
gtatagctatggag

SEQ ID NO: 3544 - DNA, 14 bp, Artificial sequence
  synthetic sequence
tattgaatgggcac

SEQ ID NO: 3545 - DNA, 14 bp, Artificial sequence
  synthetic sequence
agtgaacgtgctct

SEQ ID NO: 3546 - DNA, 14 bp, Artificial sequence
  synthetic sequence
accagtggtttagg

SEQ ID NO: 3547 - DNA, 14 bp, Artificial sequence
  synthetic sequence
atctgaattggagc

SEQ ID NO: 3548 - DNA, 14 bp, Artificial sequence
  synthetic sequence
gaactctgctaact

SEQ ID NO: 3549 - DNA, 14 bp, Artificial sequence
  synthetic sequence
tgatcggagtatca

SEQ ID NO: 3550 - DNA, 14 bp, Artificial sequence
  synthetic sequence
tccgtcgaattcca

SEQ ID NO: 3551 - DNA, 14 bp, Artificial sequence
  synthetic sequence
agtctttccaaacg

SEQ ID NO: 3552 - DNA, 14 bp, Artificial sequence
  synthetic sequence
gtgatcccctaatg

SEQ ID NO: 3553 - DNA, 14 bp, Artificial sequence
  synthetic sequence
aatctgcagttcca

SEQ ID NO: 3554 - DNA, 14 bp, Artificial sequence
  synthetic sequence
cttgacatcgtgac

SEQ ID NO: 3555 - DNA, 14 bp, Artificial sequence
  synthetic sequence
gatagttcgtcccc

SEQ ID NO: 3556 - DNA, 14 bp, Artificial sequence
  synthetic sequence
taatctggaagtgc

SEQ ID NO: 3557 - DNA, 14 bp, Artificial sequence
  synthetic sequence
atcccacgttggat

SEQ ID NO: 3558 - DNA, 14 bp, Artificial sequence
  synthetic sequence
acgtaattactaaa

SEQ ID NO: 3559 - DNA, 14 bp, Artificial sequence
  synthetic sequence
gtcgaacctctggt

SEQ ID NO: 3560 - DNA, 14 bp, Artificial sequence
  synthetic sequence
ttctgaagagatac

SEQ ID NO: 3561 - DNA, 14 bp, Artificial sequence
  synthetic sequence
catgttaccaacta

SEQ ID NO: 3562 - DNA, 14 bp, Artificial sequence
  synthetic sequence
aatgattcactaac

SEQ ID NO: 3563 - DNA, 14 bp, Artificial sequence
  synthetic sequence
aggctttaagtcgg

SEQ ID NO: 3564 - DNA, 14 bp, Artificial sequence
  synthetic sequence
ggcgatacttatag

SEQ ID NO: 3565 - DNA, 14 bp, Artificial sequence
  synthetic sequence
gttgccctccgtag

SEQ ID NO: 3566 - DNA, 14 bp, Artificial sequence
  synthetic sequence
ctaataaatgctca

SEQ ID NO: 3567 - DNA, 14 bp, Artificial sequence
  synthetic sequence
ttccactaatagcc

SEQ ID NO: 3568 - DNA, 14 bp, Artificial sequence
  synthetic sequence
ttcacaatgcgcat

SEQ ID NO: 3569 - DNA, 14 bp, Artificial sequence
  synthetic sequence
tcccgtgccatatg

SEQ ID NO: 3570 - DNA, 14 bp, Artificial sequence
  synthetic sequence
atagatacttccga

SEQ ID NO: 3571 - DNA, 14 bp, Artificial sequence
  synthetic sequence
gggatctgtaacgt

SEQ ID NO: 3572 - DNA, 14 bp, Artificial sequence
  synthetic sequence
ctagttccgaaact

SEQ ID NO: 3573 - DNA, 14 bp, Artificial sequence
  synthetic sequence
agtatgaacctaat

SEQ ID NO: 3574 - DNA, 14 bp, Artificial sequence
  synthetic sequence
ggggctacttctga

SEQ ID NO: 3575 - DNA, 14 bp, Artificial sequence
  synthetic sequence
taaacgtcttaaaa

SEQ ID NO: 3576 - DNA, 14 bp, Artificial sequence
  synthetic sequence
aaggatgtccgtct

SEQ ID NO: 3577 - DNA, 14 bp, Artificial sequence
  synthetic sequence
ccggtataattcaa

SEQ ID NO: 3578 - DNA, 14 bp, Artificial sequence
  synthetic sequence
atagcgaatcgctt

SEQ ID NO: 3579 - DNA, 14 bp, Artificial sequence
  synthetic sequence
tggatttcgacaca

SEQ ID NO: 3580 - DNA, 14 bp, Artificial sequence
  synthetic sequence
ataaggtattcaga

SEQ ID NO: 3581 - DNA, 14 bp, Artificial sequence
  synthetic sequence
agtcctggtctcgg

SEQ ID NO: 3582 - DNA, 14 bp, Artificial sequence
  synthetic sequence
agactagtgtgtcg

SEQ ID NO: 3583 - DNA, 14 bp, Artificial sequence
  synthetic sequence
ggtgtacgttgcag

SEQ ID NO: 3584 - DNA, 14 bp, Artificial sequence
  synthetic sequence
gcccgtgttcggct

SEQ ID NO: 3585 - DNA, 14 bp, Artificial sequence
  synthetic sequence
atatccctatgggc

SEQ ID NO: 3586 - DNA, 14 bp, Artificial sequence
  synthetic sequence
ggtcgcgagatttg

SEQ ID NO: 3587 - DNA, 14 bp, Artificial sequence
  synthetic sequence
ttgatgagaaactg

SEQ ID NO: 3588 - DNA, 14 bp, Artificial sequence
  synthetic sequence
cttggataccgatc

SEQ ID NO: 3589 - DNA, 14 bp, Artificial sequence
  synthetic sequence
aagtttcgagctcc

SEQ ID NO: 3590 - DNA, 14 bp, Artificial sequence
  synthetic sequence
agatccataatatc

SEQ ID NO: 3591 - DNA, 14 bp, Artificial sequence
  synthetic sequence
actgcaattgcgta

SEQ ID NO: 3592 - DNA, 14 bp, Artificial sequence
  synthetic sequence
tagtgcaactctag

SEQ ID NO: 3593 - DNA, 14 bp, Artificial sequence
  synthetic sequence
tctgtgaaaactca

SEQ ID NO: 3594 - DNA, 14 bp, Artificial sequence
  synthetic sequence
aaccgtctcgctct

SEQ ID NO: 3595 - DNA, 14 bp, Artificial sequence
  synthetic sequence
tgttgctcgcgagg

SEQ ID NO: 3596 - DNA, 14 bp, Artificial sequence
  synthetic sequence
cctcacctctagtc

SEQ ID NO: 3597 - DNA, 14 bp, Artificial sequence
  synthetic sequence
aacagtttatacaa

SEQ ID NO: 3598 - DNA, 14 bp, Artificial sequence
  synthetic sequence
ttgcgtagaacatg

SEQ ID NO: 3599 - DNA, 14 bp, Artificial sequence
  synthetic sequence
agtccagatccctt

SEQ ID NO: 3600 - DNA, 14 bp, Artificial sequence
  synthetic sequence
atgtatgcaacata

SEQ ID NO: 3601 - DNA, 14 bp, Artificial sequence
  synthetic sequence
caacgattgttcac

SEQ ID NO: 3602 - DNA, 14 bp, Artificial sequence
  synthetic sequence
caacttgaattgcg

SEQ ID NO: 3603 - DNA, 14 bp, Artificial sequence
  synthetic sequence
atcgtaccacgtgt

SEQ ID NO: 3604 - DNA, 14 bp, Artificial sequence
  synthetic sequence
atttatggaaccgc

SEQ ID NO: 3605 - DNA, 14 bp, Artificial sequence
  synthetic sequence
ttcggacctaccgt

SEQ ID NO: 3606 - DNA, 14 bp, Artificial sequence
  synthetic sequence
agtcggttgatacc

SEQ ID NO: 3607 - DNA, 14 bp, Artificial sequence
  synthetic sequence
caccgttaacctta

SEQ ID NO: 3608 - DNA, 14 bp, Artificial sequence
  synthetic sequence
gttggctgggcatc

SEQ ID NO: 3609 - DNA, 14 bp, Artificial sequence
  synthetic sequence
ttgatcgcacccat

SEQ ID NO: 3610 - DNA, 14 bp, Artificial sequence
  synthetic sequence
cgataaatgcatgt

SEQ ID NO: 3611 - DNA, 14 bp, Artificial sequence
  synthetic sequence
agtagtcacaatta

SEQ ID NO: 3612 - DNA, 14 bp, Artificial sequence
  synthetic sequence
atcggtaatggatg

SEQ ID NO: 3613 - DNA, 14 bp, Artificial sequence
  synthetic sequence
aatgcactggctgt

SEQ ID NO: 3614 - DNA, 14 bp, Artificial sequence
  synthetic sequence
gctcggttaagctg

SEQ ID NO: 3615 - DNA, 14 bp, Artificial sequence
  synthetic sequence
gaggatttcactcg

SEQ ID NO: 3616 - DNA, 14 bp, Artificial sequence
  synthetic sequence
tgatctgggactaa

SEQ ID NO: 3617 - DNA, 14 bp, Artificial sequence
  synthetic sequence
tatgacttagagac

SEQ ID NO: 3618 - DNA, 14 bp, Artificial sequence
  synthetic sequence
acagtcgaatcttg

SEQ ID NO: 3619 - DNA, 14 bp, Artificial sequence
  synthetic sequence
tatcctacgctgcc

SEQ ID NO: 3620 - DNA, 14 bp, Artificial sequence
  synthetic sequence
gctcggggtccatt

SEQ ID NO: 3621 - DNA, 14 bp, Artificial sequence
  synthetic sequence
atcaatcctgtagg

SEQ ID NO: 3622 - DNA, 14 bp, Artificial sequence
  synthetic sequence
atcgacagtccgtt

SEQ ID NO: 3623 - DNA, 14 bp, Artificial sequence
  synthetic sequence
aggctcgttaatgc

SEQ ID NO: 3624 - DNA, 14 bp, Artificial sequence
  synthetic sequence
gagggtttaggctc

SEQ ID NO: 3625 - DNA, 14 bp, Artificial sequence
  synthetic sequence
gtcgctagacttac

SEQ ID NO: 3626 - DNA, 14 bp, Artificial sequence
  synthetic sequence
ggatggtgctacct

SEQ ID NO: 3627 - DNA, 14 bp, Artificial sequence
  synthetic sequence
acgtccccattcct

SEQ ID NO: 3628 - DNA, 14 bp, Artificial sequence
  synthetic sequence
ttagaagcctgtaa

SEQ ID NO: 3629 - DNA, 14 bp, Artificial sequence
  synthetic sequence
gaattactcatgag

SEQ ID NO: 3630 - DNA, 14 bp, Artificial sequence
  synthetic sequence
tcaggacttatggg

SEQ ID NO: 3631 - DNA, 14 bp, Artificial sequence
  synthetic sequence
ggcactattatagc

SEQ ID NO: 3632 - DNA, 14 bp, Artificial sequence
  synthetic sequence
tctgcgtgcgaggt

SEQ ID NO: 3633 - DNA, 14 bp, Artificial sequence
  synthetic sequence
tgttcactacgaaa

SEQ ID NO: 3634 - DNA, 14 bp, Artificial sequence
  synthetic sequence
tatcatcacctcag

SEQ ID NO: 3635 - DNA, 14 bp, Artificial sequence
  synthetic sequence
ttatggccacatcc

SEQ ID NO: 3636 - DNA, 14 bp, Artificial sequence
  synthetic sequence
tcacgtctcggctc

SEQ ID NO: 3637 - DNA, 14 bp, Artificial sequence
  synthetic sequence
ctcttcatagacgc

SEQ ID NO: 3638 - DNA, 14 bp, Artificial sequence
  synthetic sequence
tcattcgtaccgaa

SEQ ID NO: 3639 - DNA, 14 bp, Artificial sequence
  synthetic sequence
taatccctgaaatg

SEQ ID NO: 3640 - DNA, 14 bp, Artificial sequence
  synthetic sequence
ttgaccggctctcc

SEQ ID NO: 3641 - DNA, 14 bp, Artificial sequence
  synthetic sequence
atgttcggtgaagc

SEQ ID NO: 3642 - DNA, 14 bp, Artificial sequence
  synthetic sequence
ggagctaattccat

SEQ ID NO: 3643 - DNA, 14 bp, Artificial sequence
  synthetic sequence
ctcttgtcccaggg

SEQ ID NO: 3644 - DNA, 14 bp, Artificial sequence
  synthetic sequence
gccgcactttatga

SEQ ID NO: 3645 - DNA, 14 bp, Artificial sequence
  synthetic sequence
ggaagttgcacgtt

SEQ ID NO: 3646 - DNA, 14 bp, Artificial sequence
  synthetic sequence
ttacagagtaactc

SEQ ID NO: 3647 - DNA, 14 bp, Artificial sequence
  synthetic sequence
ttggcaaaataatg

SEQ ID NO: 3648 - DNA, 14 bp, Artificial sequence
  synthetic sequence
tgctggatgtcaaa

SEQ ID NO: 3649 - DNA, 14 bp, Artificial sequence
  synthetic sequence
ttcttggcggggaa

SEQ ID NO: 3650 - DNA, 14 bp, Artificial sequence
  synthetic sequence
ggtaacagatttag

SEQ ID NO: 3651 - DNA, 14 bp, Artificial sequence
  synthetic sequence
acccgcttatccgt

SEQ ID NO: 3652 - DNA, 14 bp, Artificial sequence
  synthetic sequence
cccattcaatgatc

SEQ ID NO: 3653 - DNA, 14 bp, Artificial sequence
  synthetic sequence
tgtcctacctatcg

SEQ ID NO: 3654 - DNA, 14 bp, Artificial sequence
  synthetic sequence
tctcgtataggact

SEQ ID NO: 3655 - DNA, 14 bp, Artificial sequence
  synthetic sequence
ttcgcaggaattgt

SEQ ID NO: 3656 - DNA, 14 bp, Artificial sequence
  synthetic sequence
ggtagatcgtatat

SEQ ID NO: 3657 - DNA, 14 bp, Artificial sequence
  synthetic sequence
ttcaattcagccgt

SEQ ID NO: 3658 - DNA, 14 bp, Artificial sequence
  synthetic sequence
gacttgtattccga

SEQ ID NO: 3659 - DNA, 14 bp, Artificial sequence
  synthetic sequence
tctgtaggggtggt

SEQ ID NO: 3660 - DNA, 14 bp, Artificial sequence
  synthetic sequence
cacgtatcactttg

SEQ ID NO: 3661 - DNA, 14 bp, Artificial sequence
  synthetic sequence
atacataacctatt

SEQ ID NO: 3662 - DNA, 14 bp, Artificial sequence
  synthetic sequence
accaaggatatttt

SEQ ID NO: 3663 - DNA, 14 bp, Artificial sequence
  synthetic sequence
tttcaggtagatgg

SEQ ID NO: 3664 - DNA, 14 bp, Artificial sequence
  synthetic sequence
tagtgtatgccggt

SEQ ID NO: 3665 - DNA, 14 bp, Artificial sequence
  synthetic sequence
caggagtcggtttt

SEQ ID NO: 3666 - DNA, 14 bp, Artificial sequence
  synthetic sequence
ttaaatgcctgctc

SEQ ID NO: 3667 - DNA, 14 bp, Artificial sequence
  synthetic sequence
ttaaatccagattg

SEQ ID NO: 3668 - DNA, 14 bp, Artificial sequence
  synthetic sequence
tcttcaataacgat

SEQ ID NO: 3669 - DNA, 14 bp, Artificial sequence
  synthetic sequence
tataatggtcaagt

SEQ ID NO: 3670 - DNA, 14 bp, Artificial sequence
  synthetic sequence
accgtcggtatttc

SEQ ID NO: 3671 - DNA, 14 bp, Artificial sequence
  synthetic sequence
agagtactgtatta

SEQ ID NO: 3672 - DNA, 14 bp, Artificial sequence
  synthetic sequence
gactatggtcctat

SEQ ID NO: 3673 - DNA, 14 bp, Artificial sequence
  synthetic sequence
taaattcacagttg

SEQ ID NO: 3674 - DNA, 14 bp, Artificial sequence
  synthetic sequence
aattatgccgctta

SEQ ID NO: 3675 - DNA, 14 bp, Artificial sequence
  synthetic sequence
caagcattgctctt

SEQ ID NO: 3676 - DNA, 14 bp, Artificial sequence
  synthetic sequence
tggtggagtgtctc

SEQ ID NO: 3677 - DNA, 14 bp, Artificial sequence
  synthetic sequence
gtccggtcagcttt

SEQ ID NO: 3678 - DNA, 14 bp, Artificial sequence
  synthetic sequence
tagtgacatcgatt

SEQ ID NO: 3679 - DNA, 14 bp, Artificial sequence
  synthetic sequence
agattaggctaatt

SEQ ID NO: 3680 - DNA, 14 bp, Artificial sequence
  synthetic sequence
ctcttctgtccaaa

SEQ ID NO: 3681 - DNA, 14 bp, Artificial sequence
  synthetic sequence
ggtgtatgttagcc

SEQ ID NO: 3682 - DNA, 14 bp, Artificial sequence
  synthetic sequence
cctcgaatttgcta

SEQ ID NO: 3683 - DNA, 14 bp, Artificial sequence
  synthetic sequence
ccatttatgggtcc

SEQ ID NO: 3684 - DNA, 14 bp, Artificial sequence
  synthetic sequence
gacgatttccttaa

SEQ ID NO: 3685 - DNA, 14 bp, Artificial sequence
  synthetic sequence
tgtaccctagttag

SEQ ID NO: 3686 - DNA, 14 bp, Artificial sequence
  synthetic sequence
gcttaccgatgtct

SEQ ID NO: 3687 - DNA, 14 bp, Artificial sequence
  synthetic sequence
cattcatggtgact

SEQ ID NO: 3688 - DNA, 14 bp, Artificial sequence
  synthetic sequence
gaaatgtggatgtt

SEQ ID NO: 3689 - DNA, 14 bp, Artificial sequence
  synthetic sequence
tctaagtcatcctg

SEQ ID NO: 3690 - DNA, 14 bp, Artificial sequence
  synthetic sequence
tgtatatgaactca

SEQ ID NO: 3691 - DNA, 14 bp, Artificial sequence
  synthetic sequence
acttccggttccat

SEQ ID NO: 3692 - DNA, 14 bp, Artificial sequence
  synthetic sequence
ttcactgatatcac

SEQ ID NO: 3693 - DNA, 14 bp, Artificial sequence
  synthetic sequence
gttgtgagtgccta

SEQ ID NO: 3694 - DNA, 14 bp, Artificial sequence
  synthetic sequence
gtaagcattgagtt

SEQ ID NO: 3695 - DNA, 14 bp, Artificial sequence
  synthetic sequence
aagttatggattaa

SEQ ID NO: 3696 - DNA, 14 bp, Artificial sequence
  synthetic sequence
cacctactttactg

SEQ ID NO: 3697 - DNA, 14 bp, Artificial sequence
  synthetic sequence
aattactcttaggc

SEQ ID NO: 3698 - DNA, 14 bp, Artificial sequence
  synthetic sequence
tgctacttgacctg

SEQ ID NO: 3699 - DNA, 14 bp, Artificial sequence
  synthetic sequence
tgctatgctatgcc

SEQ ID NO: 3700 - DNA, 14 bp, Artificial sequence
  synthetic sequence
taacgcttaacatt

SEQ ID NO: 3701 - DNA, 14 bp, Artificial sequence
  synthetic sequence
tagggtatatatgc

SEQ ID NO: 3702 - DNA, 14 bp, Artificial sequence
  synthetic sequence
atgactttaggtgg

SEQ ID NO: 3703 - DNA, 14 bp, Artificial sequence
  synthetic sequence
gtcgcttaaggtgt

SEQ ID NO: 3704 - DNA, 14 bp, Artificial sequence
  synthetic sequence
tcagacctatttgg

SEQ ID NO: 3705 - DNA, 14 bp, Artificial sequence
  synthetic sequence
ctttaagctgaaat

SEQ ID NO: 3706 - DNA, 14 bp, Artificial sequence
  synthetic sequence
gtctcttgagtccg

SEQ ID NO: 3707 - DNA, 14 bp, Artificial sequence
  synthetic sequence
tgccgcttgcatct

SEQ ID NO: 3708 - DNA, 14 bp, Artificial sequence
  synthetic sequence
aattctattcacag

SEQ ID NO: 3709 - DNA, 14 bp, Artificial sequence
  synthetic sequence
gttcggactatgtg

SEQ ID NO: 3710 - DNA, 14 bp, Artificial sequence
  synthetic sequence
tcctttaaatcaag

SEQ ID NO: 3711 - DNA, 14 bp, Artificial sequence
  synthetic sequence
atctaggattccta

SEQ ID NO: 3712 - DNA, 14 bp, Artificial sequence
  synthetic sequence
tggaccttttgagg

SEQ ID NO: 3713 - DNA, 14 bp, Artificial sequence
  synthetic sequence
tgcattcgtatccg

SEQ ID NO: 3714 - DNA, 14 bp, Artificial sequence
  synthetic sequence
tatgcctgtactac

SEQ ID NO: 3715 - DNA, 14 bp, Artificial sequence
  synthetic sequence
ctgtgaatactatg

SEQ ID NO: 3716 - DNA, 14 bp, Artificial sequence
  synthetic sequence
agtaatcatttgaa

SEQ ID NO: 3717 - DNA, 14 bp, Artificial sequence
  synthetic sequence
ggctctcgttactg

SEQ ID NO: 3718 - DNA, 14 bp, Artificial sequence
  synthetic sequence
tatccctcctctca

SEQ ID NO: 3719 - DNA, 14 bp, Artificial sequence
  synthetic sequence
tgtgtccgcgtagt

SEQ ID NO: 3720 - DNA, 14 bp, Artificial sequence
  synthetic sequence
catctcacgttgtg

SEQ ID NO: 3721 - DNA, 14 bp, Artificial sequence
  synthetic sequence
ttacgaaatttcca

SEQ ID NO: 3722 - DNA, 14 bp, Artificial sequence
  synthetic sequence
agttaggaggtatt

SEQ ID NO: 3723 - DNA, 14 bp, Artificial sequence
  synthetic sequence
gtcttccctaaaat

SEQ ID NO: 3724 - DNA, 14 bp, Artificial sequence
  synthetic sequence
tcgttgccacgtct

SEQ ID NO: 3725 - DNA, 14 bp, Artificial sequence
  synthetic sequence
tctctgccctggta

SEQ ID NO: 3726 - DNA, 14 bp, Artificial sequence
  synthetic sequence
ctttaccaaattga

SEQ ID NO: 3727 - DNA, 14 bp, Artificial sequence
  synthetic sequence
atcgtttccccctc

SEQ ID NO: 3728 - DNA, 14 bp, Artificial sequence
  synthetic sequence
ggactattaagtat

SEQ ID NO: 3729 - DNA, 14 bp, Artificial sequence
  synthetic sequence
ctaaccgtcgtatt

SEQ ID NO: 3730 - DNA, 14 bp, Artificial sequence
  synthetic sequence
cgatagttagtgta

SEQ ID NO: 3731 - DNA, 14 bp, Artificial sequence
  synthetic sequence
ctcccgttaaattc

SEQ ID NO: 3732 - DNA, 14 bp, Artificial sequence
  synthetic sequence
ttaacctccgatta

SEQ ID NO: 3733 - DNA, 14 bp, Artificial sequence
  synthetic sequence
cctaactgtttgac

SEQ ID NO: 3734 - DNA, 14 bp, Artificial sequence
  synthetic sequence
attgcgtacctgta

SEQ ID NO: 3735 - DNA, 14 bp, Artificial sequence
  synthetic sequence
cctctgtgtgatcg

SEQ ID NO: 3736 - DNA, 14 bp, Artificial sequence
  synthetic sequence
ctcccattgtgatc

SEQ ID NO: 3737 - DNA, 14 bp, Artificial sequence
  synthetic sequence
tgccacttagtagt

SEQ ID NO: 3738 - DNA, 14 bp, Artificial sequence
  synthetic sequence
aaatcaatttgctg

SEQ ID NO: 3739 - DNA, 14 bp, Artificial sequence
  synthetic sequence
gcggctttcttgcc

SEQ ID NO: 3740 - DNA, 14 bp, Artificial sequence
  synthetic sequence
tctccgttgagcgt

SEQ ID NO: 3741 - DNA, 14 bp, Artificial sequence
  synthetic sequence
acttgcctagtggt

SEQ ID NO: 3742 - DNA, 14 bp, Artificial sequence
  synthetic sequence
tctcaagtactggt

SEQ ID NO: 3743 - DNA, 14 bp, Artificial sequence
  synthetic sequence
aatcagttcgtatc

SEQ ID NO: 3744 - DNA, 14 bp, Artificial sequence
  synthetic sequence
ttacaagtgttcaa

SEQ ID NO: 3745 - DNA, 14 bp, Artificial sequence
  synthetic sequence
tttcccgatgtcga

SEQ ID NO: 3746 - DNA, 14 bp, Artificial sequence
  synthetic sequence
tcctcgcaacattt

SEQ ID NO: 3747 - DNA, 14 bp, Artificial sequence
  synthetic sequence
aacatgttactagt

SEQ ID NO: 3748 - DNA, 14 bp, Artificial sequence
  synthetic sequence
ttagtggaattaaa

SEQ ID NO: 3749 - DNA, 14 bp, Artificial sequence
  synthetic sequence
gtattacttgccca

SEQ ID NO: 3750 - DNA, 14 bp, Artificial sequence
  synthetic sequence
tctatctgccagat

SEQ ID NO: 3751 - DNA, 14 bp, Artificial sequence
  synthetic sequence
accgattggtgtct

SEQ ID NO: 3752 - DNA, 14 bp, Artificial sequence
  synthetic sequence
ttacatccgtataa

SEQ ID NO: 3753 - DNA, 14 bp, Artificial sequence
  synthetic sequence
tttgtgcccgatgg

SEQ ID NO: 3754 - DNA, 14 bp, Artificial sequence
  synthetic sequence
gtaattcgtcagct

SEQ ID NO: 3755 - DNA, 14 bp, Artificial sequence
  synthetic sequence
cggctctgcctgtt

SEQ ID NO: 3756 - DNA, 14 bp, Artificial sequence
  synthetic sequence
atggtgtgagtatc

SEQ ID NO: 3757 - DNA, 14 bp, Artificial sequence
  synthetic sequence
ggttctcatccatc

SEQ ID NO: 3758 - DNA, 14 bp, Artificial sequence
  synthetic sequence
atcgactacgttta

SEQ ID NO: 3759 - DNA, 14 bp, Artificial sequence
  synthetic sequence
agatcttatggtgc

SEQ ID NO: 3760 - DNA, 14 bp, Artificial sequence
  synthetic sequence
ttactcagccggtt

SEQ ID NO: 3761 - DNA, 14 bp, Artificial sequence
  synthetic sequence
gcagtatcaatttc

SEQ ID NO: 3762 - DNA, 14 bp, Artificial sequence
  synthetic sequence
gtgtaattccagtc

SEQ ID NO: 3763 - DNA, 14 bp, Artificial sequence
  synthetic sequence
agtcgatctttcaa

SEQ ID NO: 3764 - DNA, 14 bp, Artificial sequence
  synthetic sequence
taaccctagtctat

SEQ ID NO: 3765 - DNA, 14 bp, Artificial sequence
  synthetic sequence
tgtatacgttcggc

SEQ ID NO: 3766 - DNA, 14 bp, Artificial sequence
  synthetic sequence
gcatactagtcatt

SEQ ID NO: 3767 - DNA, 14 bp, Artificial sequence
  synthetic sequence
gtcttaccaccttc

SEQ ID NO: 3768 - DNA, 14 bp, Artificial sequence
  synthetic sequence
cttcgacgtagttg

SEQ ID NO: 3769 - DNA, 14 bp, Artificial sequence
  synthetic sequence
ctcgcccattttca

SEQ ID NO: 3770 - DNA, 14 bp, Artificial sequence
  synthetic sequence
tactatctccccat

SEQ ID NO: 3771 - DNA, 14 bp, Artificial sequence
  synthetic sequence
ctccccgttatgct

SEQ ID NO: 3772 - DNA, 14 bp, Artificial sequence
  synthetic sequence
tttcgacgctcggt

SEQ ID NO: 3773 - DNA, 14 bp, Artificial sequence
  synthetic sequence
cattataatagcat

SEQ ID NO: 3774 - DNA, 14 bp, Artificial sequence
  synthetic sequence
aatgggtgtgattg

SEQ ID NO: 3775 - DNA, 14 bp, Artificial sequence
  synthetic sequence
tcagctatcataat

SEQ ID NO: 3776 - DNA, 14 bp, Artificial sequence
  synthetic sequence
gcgatgttaatctc

SEQ ID NO: 3777 - DNA, 14 bp, Artificial sequence
  synthetic sequence
tgtccagtctggta

SEQ ID NO: 3778 - DNA, 14 bp, Artificial sequence
  synthetic sequence
ggctattgatctag

SEQ ID NO: 3779 - DNA, 14 bp, Artificial sequence
  synthetic sequence
actaactattgtga

SEQ ID NO: 3780 - DNA, 14 bp, Artificial sequence
  synthetic sequence
tcggataaattact

SEQ ID NO: 3781 - DNA, 14 bp, Artificial sequence
  synthetic sequence
taagcttctcggct

SEQ ID NO: 3782 - DNA, 14 bp, Artificial sequence
  synthetic sequence
tgatccgattcgtc

SEQ ID NO: 3783 - DNA, 14 bp, Artificial sequence
  synthetic sequence
tttggcgttgagca

SEQ ID NO: 3784 - DNA, 14 bp, Artificial sequence
  synthetic sequence
gggttccgattaat

SEQ ID NO: 3785 - DNA, 14 bp, Artificial sequence
  synthetic sequence
ttcagctttaagcc

SEQ ID NO: 3786 - DNA, 14 bp, Artificial sequence
  synthetic sequence
atttggagctaact

SEQ ID NO: 3787 - DNA, 14 bp, Artificial sequence
  synthetic sequence
gggctttcctctag

SEQ ID NO: 3788 - DNA, 14 bp, Artificial sequence
  synthetic sequence
ttcgtactcactcg

SEQ ID NO: 3789 - DNA, 14 bp, Artificial sequence
  synthetic sequence
gattagtttagaag

SEQ ID NO: 3790 - DNA, 14 bp, Artificial sequence
  synthetic sequence
tgctcggttatcag

SEQ ID NO: 3791 - DNA, 14 bp, Artificial sequence
  synthetic sequence
tacgaccatttcgt

SEQ ID NO: 3792 - DNA, 14 bp, Artificial sequence
  synthetic sequence
tgggatcatatgtc

SEQ ID NO: 3793 - DNA, 14 bp, Artificial sequence
  synthetic sequence
cttatgctgaaggt

SEQ ID NO: 3794 - DNA, 14 bp, Artificial sequence
  synthetic sequence
tgtgaccttacgct

SEQ ID NO: 3795 - DNA, 14 bp, Artificial sequence
  synthetic sequence
gttgtttagaacac

SEQ ID NO: 3796 - DNA, 14 bp, Artificial sequence
  synthetic sequence
caagactttatctc

SEQ ID NO: 3797 - DNA, 14 bp, Artificial sequence
  synthetic sequence
ctttggctccctca

SEQ ID NO: 3798 - DNA, 14 bp, Artificial sequence
  synthetic sequence
tttatatggcagcg

SEQ ID NO: 3799 - DNA, 14 bp, Artificial sequence
  synthetic sequence
tggtcccttgatgc

SEQ ID NO: 3800 - DNA, 14 bp, Artificial sequence
  synthetic sequence
atagtctggtgtca

SEQ ID NO: 3801 - DNA, 14 bp, Artificial sequence
  synthetic sequence
gccacctattttag

SEQ ID NO: 3802 - DNA, 14 bp, Artificial sequence
  synthetic sequence
actctgcattgcat

SEQ ID NO: 3803 - DNA, 14 bp, Artificial sequence
  synthetic sequence
cctctgattcatgc

SEQ ID NO: 3804 - DNA, 14 bp, Artificial sequence
  synthetic sequence
atggtgtcttgccc

SEQ ID NO: 3805 - DNA, 14 bp, Artificial sequence
  synthetic sequence
cagattttaggcat

SEQ ID NO: 3806 - DNA, 14 bp, Artificial sequence
  synthetic sequence
catttcgtaatccg

SEQ ID NO: 3807 - DNA, 14 bp, Artificial sequence
  synthetic sequence
cctcgcttatcatg

SEQ ID NO: 3808 - DNA, 14 bp, Artificial sequence
  synthetic sequence
tcaatttgcaatgg

SEQ ID NO: 3809 - DNA, 14 bp, Artificial sequence
  synthetic sequence
tgtatgtagtaccc

SEQ ID NO: 3810 - DNA, 14 bp, Artificial sequence
  synthetic sequence
ctacgtaacacttt

SEQ ID NO: 3811 - DNA, 14 bp, Artificial sequence
  synthetic sequence
ggctcgtttggtcc

SEQ ID NO: 3812 - DNA, 14 bp, Artificial sequence
  synthetic sequence
tgttttcaaaaggc

SEQ ID NO: 3813 - DNA, 14 bp, Artificial sequence
  synthetic sequence
atccttgtagtaag

SEQ ID NO: 3814 - DNA, 14 bp, Artificial sequence
  synthetic sequence
caatgctgtccgtt

SEQ ID NO: 3815 - DNA, 14 bp, Artificial sequence
  synthetic sequence
ctcgctctgtaaat

SEQ ID NO: 3816 - DNA, 14 bp, Artificial sequence
  synthetic sequence
gtggtttggcccgt

SEQ ID NO: 3817 - DNA, 14 bp, Artificial sequence
  synthetic sequence
tttcgctgctaccc

SEQ ID NO: 3818 - DNA, 14 bp, Artificial sequence
  synthetic sequence
cccttggttagggt

SEQ ID NO: 3819 - DNA, 14 bp, Artificial sequence
  synthetic sequence
ttcataggataatc

SEQ ID NO: 3820 - DNA, 14 bp, Artificial sequence
  synthetic sequence
taacttgttaccac

SEQ ID NO: 3821 - DNA, 14 bp, Artificial sequence
  synthetic sequence
tgctgtaactgtaa

SEQ ID NO: 3822 - DNA, 14 bp, Artificial sequence
  synthetic sequence
caaccctctgttgt

SEQ ID NO: 3823 - DNA, 14 bp, Artificial sequence
  synthetic sequence
cctcgatgttcgct

SEQ ID NO: 3824 - DNA, 14 bp, Artificial sequence
  synthetic sequence
tccgtttaccaggt

SEQ ID NO: 3825 - DNA, 14 bp, Artificial sequence
  synthetic sequence
gggtcttctcgcta

SEQ ID NO: 3826 - DNA, 14 bp, Artificial sequence
  synthetic sequence
gtgttcactgggat

SEQ ID NO: 3827 - DNA, 14 bp, Artificial sequence
  synthetic sequence
cgtcggattctatg

SEQ ID NO: 3828 - DNA, 14 bp, Artificial sequence
  synthetic sequence
ttagcttcccagtg

SEQ ID NO: 3829 - DNA, 14 bp, Artificial sequence
  synthetic sequence
ataagatgtgcgtt

SEQ ID NO: 3830 - DNA, 14 bp, Artificial sequence
  synthetic sequence
gcgtgttgcatatc

SEQ ID NO: 3831 - DNA, 14 bp, Artificial sequence
  synthetic sequence
acgcttggtgcctt

SEQ ID NO: 3832 - DNA, 14 bp, Artificial sequence
  synthetic sequence
cagtaattgttacg

SEQ ID NO: 3833 - DNA, 14 bp, Artificial sequence
  synthetic sequence
cgagaaatttgctt

SEQ ID NO: 3834 - DNA, 14 bp, Artificial sequence
  synthetic sequence
ttatagcgttcaag

SEQ ID NO: 3835 - DNA, 14 bp, Artificial sequence
  synthetic sequence
gcttaaatgcttca

SEQ ID NO: 3836 - DNA, 14 bp, Artificial sequence
  synthetic sequence
tgattactgaggta

SEQ ID NO: 3837 - DNA, 14 bp, Artificial sequence
  synthetic sequence
gcaatattgccgtt

SEQ ID NO: 3838 - DNA, 14 bp, Artificial sequence
  synthetic sequence
ttcggtaggttgac

SEQ ID NO: 3839 - DNA, 14 bp, Artificial sequence
  synthetic sequence
tcccctgggttcct

SEQ ID NO: 3840 - DNA, 14 bp, Artificial sequence
  synthetic sequence
ttcgaaatatagat

SEQ ID NO: 3841 - DNA, 14 bp, Artificial sequence
  synthetic sequence
cgtatattgataac

SEQ ID NO: 3842 - DNA, 14 bp, Artificial sequence
  synthetic sequence
actacccggtttta

SEQ ID NO: 3843 - DNA, 14 bp, Artificial sequence
  synthetic sequence
tcttaacttcgagc

SEQ ID NO: 3844 - DNA, 14 bp, Artificial sequence
  synthetic sequence
ggcttgattaatca

SEQ ID NO: 3845 - DNA, 14 bp, Artificial sequence
  synthetic sequence
aagggtccactttt

SEQ ID NO: 3846 - DNA, 14 bp, Artificial sequence
  synthetic sequence
gtaataatgtagtc

SEQ ID NO: 3847 - DNA, 14 bp, Artificial sequence
  synthetic sequence
aatttgtcagatcg

SEQ ID NO: 3848 - DNA, 14 bp, Artificial sequence
  synthetic sequence
ttttaaggtggccg

SEQ ID NO: 3849 - DNA, 14 bp, Artificial sequence
  synthetic sequence
ttttcgcacgtgac

SEQ ID NO: 3850 - DNA, 14 bp, Artificial sequence
  synthetic sequence
ggagttatagttga

SEQ ID NO: 3851 - DNA, 14 bp, Artificial sequence
  synthetic sequence
tttacaagtatcca

SEQ ID NO: 3852 - DNA, 14 bp, Artificial sequence
  synthetic sequence
cggttccaactctt

SEQ ID NO: 3853 - DNA, 14 bp, Artificial sequence
  synthetic sequence
aggtgtctcatata

SEQ ID NO: 3854 - DNA, 14 bp, Artificial sequence
  synthetic sequence
tacactctatgaat

SEQ ID NO: 3855 - DNA, 14 bp, Artificial sequence
  synthetic sequence
gggccattaatttc

SEQ ID NO: 3856 - DNA, 14 bp, Artificial sequence
  synthetic sequence
gtttccatactcac

SEQ ID NO: 3857 - DNA, 14 bp, Artificial sequence
  synthetic sequence
gttgatctacaact

SEQ ID NO: 3858 - DNA, 14 bp, Artificial sequence
  synthetic sequence
gacgaatgttctta

SEQ ID NO: 3859 - DNA, 14 bp, Artificial sequence
  synthetic sequence
tcctaccttaatcg

SEQ ID NO: 3860 - DNA, 14 bp, Artificial sequence
  synthetic sequence
tagggtgattacct

SEQ ID NO: 3861 - DNA, 14 bp, Artificial sequence
  synthetic sequence
atggaatggtattg

SEQ ID NO: 3862 - DNA, 14 bp, Artificial sequence
  synthetic sequence
ccatttacctccgt

SEQ ID NO: 3863 - DNA, 14 bp, Artificial sequence
  synthetic sequence
tatgctattggaag

SEQ ID NO: 3864 - DNA, 14 bp, Artificial sequence
  synthetic sequence
cgtggttggacctt

SEQ ID NO: 3865 - DNA, 14 bp, Artificial sequence
  synthetic sequence
atactctaaaggtt

SEQ ID NO: 3866 - DNA, 14 bp, Artificial sequence
  synthetic sequence
actatgggggtctt

SEQ ID NO: 3867 - DNA, 14 bp, Artificial sequence
  synthetic sequence
gattactccgtagt

SEQ ID NO: 3868 - DNA, 14 bp, Artificial sequence
  synthetic sequence
agtgtctcgctaat

SEQ ID NO: 3869 - DNA, 14 bp, Artificial sequence
  synthetic sequence
atgcttatagatga

SEQ ID NO: 3870 - DNA, 14 bp, Artificial sequence
  synthetic sequence
ggttgcgcagcttt

SEQ ID NO: 3871 - DNA, 14 bp, Artificial sequence
  synthetic sequence
ccaatgttcaatct

SEQ ID NO: 3872 - DNA, 14 bp, Artificial sequence
  synthetic sequence
gaagacttttccat

SEQ ID NO: 3873 - DNA, 14 bp, Artificial sequence
  synthetic sequence
tgtgtacgggcttg

SEQ ID NO: 3874 - DNA, 14 bp, Artificial sequence
  synthetic sequence
acctattagtctaa

SEQ ID NO: 3875 - DNA, 14 bp, Artificial sequence
  synthetic sequence
aactcatctttcga

SEQ ID NO: 3876 - DNA, 14 bp, Artificial sequence
  synthetic sequence
tatgtatcctgggc

SEQ ID NO: 3877 - DNA, 14 bp, Artificial sequence
  synthetic sequence
agagcttagaattt

SEQ ID NO: 3878 - DNA, 14 bp, Artificial sequence
  synthetic sequence
ttagtagctatagc

SEQ ID NO: 3879 - DNA, 14 bp, Artificial sequence
  synthetic sequence
agtcggttcaatgt

SEQ ID NO: 3880 - DNA, 14 bp, Artificial sequence
  synthetic sequence
cgccctatgtttcg

SEQ ID NO: 3881 - DNA, 14 bp, Artificial sequence
  synthetic sequence
gttacgaaagttat

SEQ ID NO: 3882 - DNA, 14 bp, Artificial sequence
  synthetic sequence
ctgcttgtatcgca

SEQ ID NO: 3883 - DNA, 14 bp, Artificial sequence
  synthetic sequence
atcgagagctttct

SEQ ID NO: 3884 - DNA, 14 bp, Artificial sequence
  synthetic sequence
ttgatcgtcacatg

SEQ ID NO: 3885 - DNA, 14 bp, Artificial sequence
  synthetic sequence
tcaatgtctcaatg

SEQ ID NO: 3886 - DNA, 14 bp, Artificial sequence
  synthetic sequence
gttgatgtgtggcg

SEQ ID NO: 3887 - DNA, 14 bp, Artificial sequence
  synthetic sequence
atagcttcttacag

SEQ ID NO: 3888 - DNA, 14 bp, Artificial sequence
  synthetic sequence
tctaatctgtaaaa

SEQ ID NO: 3889 - DNA, 14 bp, Artificial sequence
  synthetic sequence
tgggggtctattca

SEQ ID NO: 3890 - DNA, 14 bp, Artificial sequence
  synthetic sequence
tgcctggtatctag

SEQ ID NO: 3891 - DNA, 14 bp, Artificial sequence
  synthetic sequence
catctagtatgtga

SEQ ID NO: 3892 - DNA, 14 bp, Artificial sequence
  synthetic sequence
tgctatgtaataga

SEQ ID NO: 3893 - DNA, 14 bp, Artificial sequence
  synthetic sequence
cactaagtcattat

SEQ ID NO: 3894 - DNA, 14 bp, Artificial sequence
  synthetic sequence
ttcaacgctacctt

SEQ ID NO: 3895 - DNA, 14 bp, Artificial sequence
  synthetic sequence
cctattaagtgtac

SEQ ID NO: 3896 - DNA, 14 bp, Artificial sequence
  synthetic sequence
atgggtctccttac

SEQ ID NO: 3897 - DNA, 14 bp, Artificial sequence
  synthetic sequence
ttgcacacgcttct

SEQ ID NO: 3898 - DNA, 14 bp, Artificial sequence
  synthetic sequence
tggtgctaaatcta

SEQ ID NO: 3899 - DNA, 14 bp, Artificial sequence
  synthetic sequence
acttgcactgattg

SEQ ID NO: 3900 - DNA, 14 bp, Artificial sequence
  synthetic sequence
ggttttgaatacga

SEQ ID NO: 3901 - DNA, 14 bp, Artificial sequence
  synthetic sequence
ttggctatcgccat

SEQ ID NO: 3902 - DNA, 14 bp, Artificial sequence
  synthetic sequence
tgttagataagaat

SEQ ID NO: 3903 - DNA, 14 bp, Artificial sequence
  synthetic sequence
taatcactgatgct

SEQ ID NO: 3904 - DNA, 14 bp, Artificial sequence
  synthetic sequence
tgtttacgaaaata

SEQ ID NO: 3905 - DNA, 14 bp, Artificial sequence
  synthetic sequence
tggtaataagtcgt

SEQ ID NO: 3906 - DNA, 14 bp, Artificial sequence
  synthetic sequence
tgtagatgtctacg

SEQ ID NO: 3907 - DNA, 14 bp, Artificial sequence
  synthetic sequence
ttgctacttaagcc

SEQ ID NO: 3908 - DNA, 14 bp, Artificial sequence
  synthetic sequence
cgacttcctttcac

SEQ ID NO: 3909 - DNA, 14 bp, Artificial sequence
  synthetic sequence
tagcctttatcgcc

SEQ ID NO: 3910 - DNA, 14 bp, Artificial sequence
  synthetic sequence
actaagctttgtcg

SEQ ID NO: 3911 - DNA, 14 bp, Artificial sequence
  synthetic sequence
ttcaatggccattt

SEQ ID NO: 3912 - DNA, 14 bp, Artificial sequence
  synthetic sequence
ttcttacccttacc

SEQ ID NO: 3913 - DNA, 14 bp, Artificial sequence
  synthetic sequence
gttattctaatggc

SEQ ID NO: 3914 - DNA, 14 bp, Artificial sequence
  synthetic sequence
ttctttcaccgtgg

SEQ ID NO: 3915 - DNA, 14 bp, Artificial sequence
  synthetic sequence
ggttccttaagtct

SEQ ID NO: 3916 - DNA, 14 bp, Artificial sequence
  synthetic sequence
cttcagatatgtta

SEQ ID NO: 3917 - DNA, 14 bp, Artificial sequence
  synthetic sequence
ttacttaggtccat

SEQ ID NO: 3918 - DNA, 14 bp, Artificial sequence
  synthetic sequence
cgtcttgtcctata

SEQ ID NO: 3919 - DNA, 14 bp, Artificial sequence
  synthetic sequence
tggaagttgtttca

SEQ ID NO: 3920 - DNA, 14 bp, Artificial sequence
  synthetic sequence
actttagctcgtat

SEQ ID NO: 3921 - DNA, 14 bp, Artificial sequence
  synthetic sequence
actagagtttattc

SEQ ID NO: 3922 - DNA, 14 bp, Artificial sequence
  synthetic sequence
gcagttgtgtgatt

SEQ ID NO: 3923 - DNA, 14 bp, Artificial sequence
  synthetic sequence
gttttatgccacct

SEQ ID NO: 3924 - DNA, 14 bp, Artificial sequence
  synthetic sequence
atgagattcgattt

SEQ ID NO: 3925 - DNA, 14 bp, Artificial sequence
  synthetic sequence
tgcacactttatat

SEQ ID NO: 3926 - DNA, 14 bp, Artificial sequence
  synthetic sequence
ctatgatctgtact

SEQ ID NO: 3927 - DNA, 14 bp, Artificial sequence
  synthetic sequence
cgcttagttgtcgt

SEQ ID NO: 3928 - DNA, 14 bp, Artificial sequence
  synthetic sequence
ttttattagcgcga

SEQ ID NO: 3929 - DNA, 14 bp, Artificial sequence
  synthetic sequence
atccgttcttccat

SEQ ID NO: 3930 - DNA, 14 bp, Artificial sequence
  synthetic sequence
tcctgccgatttgt

SEQ ID NO: 3931 - DNA, 14 bp, Artificial sequence
  synthetic sequence
tatcgctagctctt

SEQ ID NO: 3932 - DNA, 14 bp, Artificial sequence
  synthetic sequence
cgatccttatctta

SEQ ID NO: 3933 - DNA, 14 bp, Artificial sequence
  synthetic sequence
actataaatccttt

SEQ ID NO: 3934 - DNA, 14 bp, Artificial sequence
  synthetic sequence
atatgtaaggtgtt

SEQ ID NO: 3935 - DNA, 14 bp, Artificial sequence
  synthetic sequence
ggtctggctcttct

SEQ ID NO: 3936 - DNA, 14 bp, Artificial sequence
  synthetic sequence
tttgatcagtaatg

SEQ ID NO: 3937 - DNA, 14 bp, Artificial sequence
  synthetic sequence
tagattggtatata

SEQ ID NO: 3938 - DNA, 14 bp, Artificial sequence
  synthetic sequence
ctgttacatgtcta

SEQ ID NO: 3939 - DNA, 14 bp, Artificial sequence
  synthetic sequence
taatcttacttggc

SEQ ID NO: 3940 - DNA, 14 bp, Artificial sequence
  synthetic sequence
cccctctatttatc

SEQ ID NO: 3941 - DNA, 14 bp, Artificial sequence
  synthetic sequence
tcgtattgttacac

SEQ ID NO: 3942 - DNA, 14 bp, Artificial sequence
  synthetic sequence
tcattcgatctcgt

SEQ ID NO: 3943 - DNA, 14 bp, Artificial sequence
  synthetic sequence
agatctgactttat

SEQ ID NO: 3944 - DNA, 14 bp, Artificial sequence
  synthetic sequence
agtttgtttgaaac

SEQ ID NO: 3945 - DNA, 14 bp, Artificial sequence
  synthetic sequence
aagtgtgcttcatt

SEQ ID NO: 3946 - DNA, 14 bp, Artificial sequence
  synthetic sequence
ttcctgttatcaga

SEQ ID NO: 3947 - DNA, 14 bp, Artificial sequence
  synthetic sequence
ctttgccctgttca

SEQ ID NO: 3948 - DNA, 14 bp, Artificial sequence
  synthetic sequence
gctagtgctctctt

SEQ ID NO: 3949 - DNA, 14 bp, Artificial sequence
  synthetic sequence
ctgctggttaagtt

SEQ ID NO: 3950 - DNA, 14 bp, Artificial sequence
  synthetic sequence
actgcatttttgag

SEQ ID NO: 3951 - DNA, 14 bp, Artificial sequence
  synthetic sequence
atgatgttggttac

SEQ ID NO: 3952 - DNA, 14 bp, Artificial sequence
  synthetic sequence
acactttatactta

SEQ ID NO: 3953 - DNA, 14 bp, Artificial sequence
  synthetic sequence
atgtttctaaagtg

SEQ ID NO: 3954 - DNA, 14 bp, Artificial sequence
  synthetic sequence
tgtgttgacatctc

SEQ ID NO: 3955 - DNA, 14 bp, Artificial sequence
  synthetic sequence
tgttatatagctcc

SEQ ID NO: 3956 - DNA, 14 bp, Artificial sequence
  synthetic sequence
acttaagtctttga

SEQ ID NO: 3957 - DNA, 14 bp, Artificial sequence
  synthetic sequence
gctgtctggatatt

SEQ ID NO: 3958 - DNA, 14 bp, Artificial sequence
  synthetic sequence
ctgttaatcaggtt

SEQ ID NO: 3959 - DNA, 14 bp, Artificial sequence
  synthetic sequence
aaatcttcctgatt

SEQ ID NO: 3960 - DNA, 14 bp, Artificial sequence
  synthetic sequence
gtaaagtggtgttt

SEQ ID NO: 3961 - DNA, 14 bp, Artificial sequence
  synthetic sequence
tatcatcctgtgat

SEQ ID NO: 3962 - DNA, 14 bp, Artificial sequence
  synthetic sequence
cttagtgcctttac

SEQ ID NO: 3963 - DNA, 14 bp, Artificial sequence
  synthetic sequence
agttctctatatac

SEQ ID NO: 3964 - DNA, 14 bp, Artificial sequence
  synthetic sequence
ggctaatttttgca

SEQ ID NO: 3965 - DNA, 14 bp, Artificial sequence
  synthetic sequence
attggccgtcttat

SEQ ID NO: 3966 - DNA, 14 bp, Artificial sequence
  synthetic sequence
tctccttcttccga

SEQ ID NO: 3967 - DNA, 14 bp, Artificial sequence
  synthetic sequence
cttttcaggcactt

SEQ ID NO: 3968 - DNA, 14 bp, Artificial sequence
  synthetic sequence
gtggtttaattgcg

SEQ ID NO: 3969 - DNA, 14 bp, Artificial sequence
  synthetic sequence
agtgattacttcct

SEQ ID NO: 3970 - DNA, 14 bp, Artificial sequence
  synthetic sequence
ctagtcgtgtttaa

SEQ ID NO: 3971 - DNA, 14 bp, Artificial sequence
  synthetic sequence
catactttatctgc

SEQ ID NO: 3972 - DNA, 14 bp, Artificial sequence
  synthetic sequence
attgtatgatcaat

SEQ ID NO: 3973 - DNA, 14 bp, Artificial sequence
  synthetic sequence
gttaattggacatt

SEQ ID NO: 3974 - DNA, 14 bp, Artificial sequence
  synthetic sequence
cctttggatatcat

SEQ ID NO: 3975 - DNA, 14 bp, Artificial sequence
  synthetic sequence
taattctggcgctt

SEQ ID NO: 3976 - DNA, 14 bp, Artificial sequence
  synthetic sequence
tcgttatctccaat

SEQ ID NO: 3977 - DNA, 14 bp, Artificial sequence
  synthetic sequence
gaatttttactgcc

SEQ ID NO: 3978 - DNA, 14 bp, Artificial sequence
  synthetic sequence
ttggccctgatctt

SEQ ID NO: 3979 - DNA, 14 bp, Artificial sequence
  synthetic sequence
ttgccggtcatttc

SEQ ID NO: 3980 - DNA, 14 bp, Artificial sequence
  synthetic sequence
tgacggtttatcct

SEQ ID NO: 3981 - DNA, 14 bp, Artificial sequence
  synthetic sequence
tggtgcactattgt

SEQ ID NO: 3982 - DNA, 14 bp, Artificial sequence
  synthetic sequence
gtcctactgtatat

SEQ ID NO: 3983 - DNA, 14 bp, Artificial sequence
  synthetic sequence
ccgatacttattat

SEQ ID NO: 3984 - DNA, 14 bp, Artificial sequence
  synthetic sequence
gtttcctgcgctgt

SEQ ID NO: 3985 - DNA, 14 bp, Artificial sequence
  synthetic sequence
tttaacctcctgta

SEQ ID NO: 3986 - DNA, 14 bp, Artificial sequence
  synthetic sequence
ctttttcactcgga

SEQ ID NO: 3987 - DNA, 14 bp, Artificial sequence
  synthetic sequence
ctttaatgatggat

SEQ ID NO: 3988 - DNA, 14 bp, Artificial sequence
  synthetic sequence
tctagttaactgtc

SEQ ID NO: 3989 - DNA, 14 bp, Artificial sequence
  synthetic sequence
atcttgtttcggga

SEQ ID NO: 3990 - DNA, 14 bp, Artificial sequence
  synthetic sequence
gttagtaatttcac

SEQ ID NO: 3991 - DNA, 14 bp, Artificial sequence
  synthetic sequence
gtttgataaaagtt

SEQ ID NO: 3992 - DNA, 14 bp, Artificial sequence
  synthetic sequence
tccattcaggtatt

SEQ ID NO: 3993 - DNA, 14 bp, Artificial sequence
  synthetic sequence
gggtcttcttaggt

SEQ ID NO: 3994 - DNA, 14 bp, Artificial sequence
  synthetic sequence
tcctttgctacagt

SEQ ID NO: 3995 - DNA, 14 bp, Artificial sequence
  synthetic sequence
attaggtttaactg

SEQ ID NO: 3996 - DNA, 14 bp, Artificial sequence
  synthetic sequence
ctcgattattctgc

SEQ ID NO: 3997 - DNA, 14 bp, Artificial sequence
  synthetic sequence
tctcctccgctctt

SEQ ID NO: 3998 - DNA, 14 bp, Artificial sequence
  synthetic sequence
acttagattcgtta

SEQ ID NO: 3999 - DNA, 14 bp, Artificial sequence
  synthetic sequence
tcaggattttagat

SEQ ID NO: 4000 - DNA, 14 bp, Artificial sequence
  synthetic sequence
ctcttcctagtgat

SEQ ID NO: 4001 - DNA, 14 bp, Artificial sequence
  synthetic sequence
gtattaagatgatt

SEQ ID NO: 4002 - DNA, 14 bp, Artificial sequence
  synthetic sequence
gattgtcttctgcg

SEQ ID NO: 4003 - DNA, 14 bp, Artificial sequence
  synthetic sequence
gttctaccgttctc

SEQ ID NO: 4004 - DNA, 14 bp, Artificial sequence
  synthetic sequence
catatctgaatctt

SEQ ID NO: 4005 - DNA, 14 bp, Artificial sequence
  synthetic sequence
tagtcaattaagtt

SEQ ID NO: 4006 - DNA, 14 bp, Artificial sequence
  synthetic sequence
gattttgttgccaa

SEQ ID NO: 4007 - DNA, 14 bp, Artificial sequence
  synthetic sequence
cccgttattatagt

SEQ ID NO: 4008 - DNA, 14 bp, Artificial sequence
  synthetic sequence
gctttgtaactgtg

SEQ ID NO: 4009 - DNA, 14 bp, Artificial sequence
  synthetic sequence
acattatttgaggt

SEQ ID NO: 4010 - DNA, 14 bp, Artificial sequence
  synthetic sequence
gcttttggcgttcc

SEQ ID NO: 4011 - DNA, 14 bp, Artificial sequence
  synthetic sequence
atgcgtcttctact

SEQ ID NO: 4012 - DNA, 14 bp, Artificial sequence
  synthetic sequence
tttctgacattagc

SEQ ID NO: 4013 - DNA, 14 bp, Artificial sequence
  synthetic sequence
ttgtggcctccttg

SEQ ID NO: 4014 - DNA, 14 bp, Artificial sequence
  synthetic sequence
atcttcaacgttgt

SEQ ID NO: 4015 - DNA, 14 bp, Artificial sequence
  synthetic sequence
ctgttctcaatctc

SEQ ID NO: 4016 - DNA, 14 bp, Artificial sequence
  synthetic sequence
cactagtttacgtt

SEQ ID NO: 4017 - DNA, 14 bp, Artificial sequence
  synthetic sequence
ttctgcatgctgat

SEQ ID NO: 4018 - DNA, 14 bp, Artificial sequence
  synthetic sequence
agcactcttgttta

SEQ ID NO: 4019 - DNA, 14 bp, Artificial sequence
  synthetic sequence
ctggtaatttatca

SEQ ID NO: 4020 - DNA, 14 bp, Artificial sequence
  synthetic sequence
ttggggtccatgtt

SEQ ID NO: 4021 - DNA, 14 bp, Artificial sequence
  synthetic sequence
catatggtctatta

SEQ ID NO: 4022 - DNA, 14 bp, Artificial sequence
  synthetic sequence
gtaacgattttgta

SEQ ID NO: 4023 - DNA, 14 bp, Artificial sequence
  synthetic sequence
ctgtcgttatctcc

SEQ ID NO: 4024 - DNA, 14 bp, Artificial sequence
  synthetic sequence
gtcgttatcgcatt

SEQ ID NO: 4025 - DNA, 14 bp, Artificial sequence
  synthetic sequence
ctccttttggcaat

SEQ ID NO: 4026 - DNA, 14 bp, Artificial sequence
  synthetic sequence
cgttttaaattccc

SEQ ID NO: 4027 - DNA, 14 bp, Artificial sequence
  synthetic sequence
acgttcattaaatt

SEQ ID NO: 4028 - DNA, 14 bp, Artificial sequence
  synthetic sequence
acttgtttacgcct

SEQ ID NO: 4029 - DNA, 14 bp, Artificial sequence
  synthetic sequence
ctctattcaattgc

SEQ ID NO: 4030 - DNA, 14 bp, Artificial sequence
  synthetic sequence
agccttgttatggt

SEQ ID NO: 4031 - DNA, 14 bp, Artificial sequence
  synthetic sequence
atgactctgtgtct

SEQ ID NO: 4032 - DNA, 14 bp, Artificial sequence
  synthetic sequence
tatcttgagattca

SEQ ID NO: 4033 - DNA, 14 bp, Artificial sequence
  synthetic sequence
atactggctgttta

SEQ ID NO: 4034 - DNA, 14 bp, Artificial sequence
  synthetic sequence
ttttcgctggtcgg

SEQ ID NO: 4035 - DNA, 14 bp, Artificial sequence
  synthetic sequence
atttcgtgatatgc

SEQ ID NO: 4036 - DNA, 14 bp, Artificial sequence
  synthetic sequence
tccgtttctgatga

SEQ ID NO: 4037 - DNA, 14 bp, Artificial sequence
  synthetic sequence
catattgctttccc

SEQ ID NO: 4038 - DNA, 14 bp, Artificial sequence
  synthetic sequence
aactctcttaattg

SEQ ID NO: 4039 - DNA, 14 bp, Artificial sequence
  synthetic sequence
tgacgttgacattt

SEQ ID NO: 4040 - DNA, 14 bp, Artificial sequence
  synthetic sequence
tgccctgttgtctt

SEQ ID NO: 4041 - DNA, 14 bp, Artificial sequence
  synthetic sequence
cgaagtttgatttt

SEQ ID NO: 4042 - DNA, 14 bp, Artificial sequence
  synthetic sequence
ttctttagatgggt

SEQ ID NO: 4043 - DNA, 14 bp, Artificial sequence
  synthetic sequence
tagacctatttctt

SEQ ID NO: 4044 - DNA, 14 bp, Artificial sequence
  synthetic sequence
attatttacgtcgt

SEQ ID NO: 4045 - DNA, 14 bp, Artificial sequence
  synthetic sequence
tagtatttcgttcc

SEQ ID NO: 4046 - DNA, 14 bp, Artificial sequence
  synthetic sequence
gtcactttcttaat

SEQ ID NO: 4047 - DNA, 14 bp, Artificial sequence
  synthetic sequence
tagcctgtatgttt

SEQ ID NO: 4048 - DNA, 14 bp, Artificial sequence
  synthetic sequence
ctttacttagatct

SEQ ID NO: 4049 - DNA, 14 bp, Artificial sequence
  synthetic sequence
tttagagtgtttag

SEQ ID NO: 4050 - DNA, 14 bp, Artificial sequence
  synthetic sequence
cttgccttttatgc

SEQ ID NO: 4051 - DNA, 14 bp, Artificial sequence
  synthetic sequence
tattgttatgtgaa

SEQ ID NO: 4052 - DNA, 14 bp, Artificial sequence
  synthetic sequence
gtccttaattcctt

SEQ ID NO: 4053 - DNA, 14 bp, Artificial sequence
  synthetic sequence
ttttggtcatctaa

SEQ ID NO: 4054 - DNA, 14 bp, Artificial sequence
  synthetic sequence
tgtttgatcgcatt

SEQ ID NO: 4055 - DNA, 14 bp, Artificial sequence
  synthetic sequence
tactttagcgattt

SEQ ID NO: 4056 - DNA, 14 bp, Artificial sequence
  synthetic sequence
atagattttctcat

SEQ ID NO: 4057 - DNA, 14 bp, Artificial sequence
  synthetic sequence
ttatcttgtatgcc

SEQ ID NO: 4058 - DNA, 14 bp, Artificial sequence
  synthetic sequence
ttcgtgtagtgtgt

SEQ ID NO: 4059 - DNA, 14 bp, Artificial sequence
  synthetic sequence
tcttcgcttcgtat

SEQ ID NO: 4060 - DNA, 14 bp, Artificial sequence
  synthetic sequence
gctccttgttactt

SEQ ID NO: 4061 - DNA, 14 bp, Artificial sequence
  synthetic sequence
actcttttcagatt

SEQ ID NO: 4062 - DNA, 14 bp, Artificial sequence
  synthetic sequence
gtgatctatgattt

SEQ ID NO: 4063 - DNA, 14 bp, Artificial sequence
  synthetic sequence
taactgctatcttt

SEQ ID NO: 4064 - DNA, 14 bp, Artificial sequence
  synthetic sequence
actttttagatgct

SEQ ID NO: 4065 - DNA, 14 bp, Artificial sequence
  synthetic sequence
tatttgtgttacca

SEQ ID NO: 4066 - DNA, 14 bp, Artificial sequence
  synthetic sequence
tctccgtaatttgt

SEQ ID NO: 4067 - DNA, 14 bp, Artificial sequence
  synthetic sequence
tgcccttaattttc

SEQ ID NO: 4068 - DNA, 14 bp, Artificial sequence
  synthetic sequence
acgtatcgtttttg

SEQ ID NO: 4069 - DNA, 14 bp, Artificial sequence
  synthetic sequence
gtcagtgtactttt

SEQ ID NO: 4070 - DNA, 14 bp, Artificial sequence
  synthetic sequence
ttgccttgtgatta

SEQ ID NO: 4071 - DNA, 14 bp, Artificial sequence
  synthetic sequence
ggggattttaattt

SEQ ID NO: 4072 - DNA, 14 bp, Artificial sequence
  synthetic sequence
tttgttgtcgtgcc

SEQ ID NO: 4073 - DNA, 14 bp, Artificial sequence
  synthetic sequence
atattttgccctta

SEQ ID NO: 4074 - DNA, 14 bp, Artificial sequence
  synthetic sequence
tcttattggtcgta

SEQ ID NO: 4075 - DNA, 14 bp, Artificial sequence
  synthetic sequence
gcttaaattttgtg

SEQ ID NO: 4076 - DNA, 14 bp, Artificial sequence
  synthetic sequence
agttgttgattata

SEQ ID NO: 4077 - DNA, 14 bp, Artificial sequence
  synthetic sequence
cattctgtattgtg

SEQ ID NO: 4078 - DNA, 14 bp, Artificial sequence
  synthetic sequence
tttcattatggtaa

SEQ ID NO: 4079 - DNA, 14 bp, Artificial sequence
  synthetic sequence
tgtacttactctgt

SEQ ID NO: 4080 - DNA, 14 bp, Artificial sequence
  synthetic sequence
atcttaactgcttt

SEQ ID NO: 4081 - DNA, 14 bp, Artificial sequence
  synthetic sequence
tgttataacttcta

SEQ ID NO: 4082 - DNA, 14 bp, Artificial sequence
  synthetic sequence
gtttattcgtatgc

SEQ ID NO: 4083 - DNA, 14 bp, Artificial sequence
  synthetic sequence
gtgcttttccttta

SEQ ID NO: 4084 - DNA, 14 bp, Artificial sequence
  synthetic sequence
tcatttcacttgtt

SEQ ID NO: 4085 - DNA, 14 bp, Artificial sequence
  synthetic sequence
gatttttctcagtt

SEQ ID NO: 4086 - DNA, 14 bp, Artificial sequence
  synthetic sequence
gtattggttttgct

SEQ ID NO: 4087 - DNA, 14 bp, Artificial sequence
  synthetic sequence
tatcctttgcttgt

SEQ ID NO: 4088 - DNA, 14 bp, Artificial sequence
  synthetic sequence
cttttgcttgcttg

SEQ ID NO: 4089 - DNA, 14 bp, Artificial sequence
  synthetic sequence
tttgttgcttgatg

SEQ ID NO: 4090 - DNA, 14 bp, Artificial sequence
  synthetic sequence
tctttggattttcc

SEQ ID NO: 4091 - DNA, 14 bp, Artificial sequence
  synthetic sequence
atttgtgtttgctg

SEQ ID NO: 4092 - DNA, 14 bp, Artificial sequence
  synthetic sequence
tgtacggtttttta

SEQ ID NO: 4093 - DNA, 14 bp, Artificial sequence
  synthetic sequence
ccgtaattattttt

SEQ ID NO: 4094 - DNA, 14 bp, Artificial sequence
  synthetic sequence
tttttgcgtagatt

SEQ ID NO: 4095 - DNA, 14 bp, Artificial sequence
  synthetic sequence
gtgttcgttgtatt

SEQ ID NO: 4096 - DNA, 14 bp, Artificial sequence
  synthetic sequence
tctcattatctttg

SEQ ID NO: 4097 - DNA, 14 bp, Artificial sequence
  synthetic sequence
tggtgcttcctttt

SEQ ID NO: 4098 - DNA, 14 bp, Artificial sequence
  synthetic sequence
gtttttcaatgctt

SEQ ID NO: 4099 - DNA, 14 bp, Artificial sequence
  synthetic sequence
ttgcttgattaatt

SEQ ID NO: 4100 - DNA, 14 bp, Artificial sequence
  synthetic sequence
tattttgtcttgaa

SEQ ID NO: 4101 - DNA, 14 bp, Artificial sequence
  synthetic sequence
ctttattgctttag

SEQ ID NO: 4102 - DNA, 14 bp, Artificial sequence
  synthetic sequence
gttccattttcatt

SEQ ID NO: 4103 - DNA, 14 bp, Artificial sequence
  synthetic sequence
gttagttgtttact

SEQ ID NO: 4104 - DNA, 14 bp, Artificial sequence
  synthetic sequence
tttctctgtaatct

SEQ ID NO: 4105 - DNA, 14 bp, Artificial sequence
  synthetic sequence
ccttttccttgtct

SEQ ID NO: 4106 - DNA, 14 bp, Artificial sequence
  synthetic sequence
ttctttgagtgtta

SEQ ID NO: 4107 - DNA, 14 bp, Artificial sequence
  synthetic sequence
ttactgtcttgctt

SEQ ID NO: 4108 - DNA, 14 bp, Artificial sequence
  synthetic sequence
tccttatttttggg

SEQ ID NO: 4109 - DNA, 14 bp, Artificial sequence
  synthetic sequence
tttgtgtaattcct

SEQ ID NO: 4110 - DNA, 14 bp, Artificial sequence
  synthetic sequence
atgtatttttcgct

SEQ ID NO: 4111 - DNA, 14 bp, Artificial sequence
  synthetic sequence
aatactttttggtt

SEQ ID NO: 4112 - DNA, 14 bp, Artificial sequence
  synthetic sequence
cctttattcggttt

SEQ ID NO: 4113 - DNA, 14 bp, Artificial sequence
  synthetic sequence
ttcgatcgtttgtt

SEQ ID NO: 4114 - DNA, 14 bp, Artificial sequence
  synthetic sequence
gttttacttttcgg

SEQ ID NO: 4115 - DNA, 14 bp, Artificial sequence
  synthetic sequence
tttactctgtattc

SEQ ID NO: 4116 - DNA, 14 bp, Artificial sequence
  synthetic sequence
tttagtctgttagt

SEQ ID NO: 4117 - DNA, 14 bp, Artificial sequence
  synthetic sequence
ttgttttcatcatg

SEQ ID NO: 4118 - DNA, 14 bp, Artificial sequence
  synthetic sequence
agtttttccatttt

SEQ ID NO: 4119 - DNA, 14 bp, Artificial sequence
  synthetic sequence
atcgtcttttcttt

SEQ ID NO: 4120 - DNA, 14 bp, Artificial sequence
  synthetic sequence
attgtgttcttatt

SEQ ID NO: 4121 - DNA, 14 bp, Artificial sequence
  synthetic sequence
ttccgtatttgttt

SEQ ID NO: 4122 - DNA, 14 bp, Artificial sequence
  synthetic sequence
tagtgtttttgttg

SEQ ID NO: 4123 - DNA, 14 bp, Artificial sequence
  synthetic sequence
ctttgcttgttttg

SEQ ID NO: 4124 - DNA, 14 bp, Artificial sequence
  synthetic sequence
ttttctttcgttga

SEQ ID NO: 4125 - DNA, 14 bp, Artificial sequence
  synthetic sequence
ttgcttctatttgt

SEQ ID NO: 4126 - DNA, 14 bp, Artificial sequence
  synthetic sequence
ctggaagaacccgc

SEQ ID NO: 4127 - DNA, 14 bp, Artificial sequence
  synthetic sequence
cacgcgacgatacc

SEQ ID NO: 4128 - DNA, 14 bp, Artificial sequence
  synthetic sequence
ggcgatcagggcag

SEQ ID NO: 4129 - DNA, 14 bp, Artificial sequence
  synthetic sequence
tacacgagaaccga

SEQ ID NO: 4130 - DNA, 14 bp, Artificial sequence
  synthetic sequence
gacacctccccaaa

SEQ ID NO: 4131 - DNA, 14 bp, Artificial sequence
  synthetic sequence
agcgcgtcgaacag

SEQ ID NO: 4132 - DNA, 14 bp, Artificial sequence
  synthetic sequence
aatcccccgcccaa

SEQ ID NO: 4133 - DNA, 14 bp, Artificial sequence
  synthetic sequence
cagcaacgaaacgt

SEQ ID NO: 4134 - DNA, 14 bp, Artificial sequence
  synthetic sequence
acccgcaaaggtgg

SEQ ID NO: 4135 - DNA, 14 bp, Artificial sequence
  synthetic sequence
gcataaacggacca

SEQ ID NO: 4136 - DNA, 14 bp, Artificial sequence
  synthetic sequence
atccagagccaacc

SEQ ID NO: 4137 - DNA, 14 bp, Artificial sequence
  synthetic sequence
caaccggtcacggg

SEQ ID NO: 4138 - DNA, 14 bp, Artificial sequence
  synthetic sequence
ggaggccagcctag

SEQ ID NO: 4139 - DNA, 14 bp, Artificial sequence
  synthetic sequence
cagaactagcacga

SEQ ID NO: 4140 - DNA, 14 bp, Artificial sequence
  synthetic sequence
agacccgcaatcag

SEQ ID NO: 4141 - DNA, 14 bp, Artificial sequence
  synthetic sequence
accccctcgaccgc

SEQ ID NO: 4142 - DNA, 14 bp, Artificial sequence
  synthetic sequence
aaccgtccgcagcg

SEQ ID NO: 4143 - DNA, 14 bp, Artificial sequence
  synthetic sequence
agagcacgtaaggg

SEQ ID NO: 4144 - DNA, 14 bp, Artificial sequence
  synthetic sequence
agacgggcacatgc

SEQ ID NO: 4145 - DNA, 14 bp, Artificial sequence
  synthetic sequence
gataaaggagcccc

SEQ ID NO: 4146 - DNA, 14 bp, Artificial sequence
  synthetic sequence
cacagctggaacca

SEQ ID NO: 4147 - DNA, 14 bp, Artificial sequence
  synthetic sequence
gaaagacaacgagt

SEQ ID NO: 4148 - DNA, 14 bp, Artificial sequence
  synthetic sequence
cgaggaaaaggtta

SEQ ID NO: 4149 - DNA, 14 bp, Artificial sequence
  synthetic sequence
aacccaagtgtaaa

SEQ ID NO: 4150 - DNA, 14 bp, Artificial sequence
  synthetic sequence
gcaaactccgggat

SEQ ID NO: 4151 - DNA, 14 bp, Artificial sequence
  synthetic sequence
gccacttgggccag

SEQ ID NO: 4152 - DNA, 14 bp, Artificial sequence
  synthetic sequence
aggcccacagcgtt

SEQ ID NO: 4153 - DNA, 14 bp, Artificial sequence
  synthetic sequence
tgctacggcacaca

SEQ ID NO: 4154 - DNA, 14 bp, Artificial sequence
  synthetic sequence
ctctcaaagaaaga

SEQ ID NO: 4155 - DNA, 14 bp, Artificial sequence
  synthetic sequence
gcacccctcacagt

SEQ ID NO: 4156 - DNA, 14 bp, Artificial sequence
  synthetic sequence
atccaggcagagtg

SEQ ID NO: 4157 - DNA, 14 bp, Artificial sequence
  synthetic sequence
caggataaagactg

SEQ ID NO: 4158 - DNA, 14 bp, Artificial sequence
  synthetic sequence
ctccaactcggggg

SEQ ID NO: 4159 - DNA, 14 bp, Artificial sequence
  synthetic sequence
tatgggagccaacg

SEQ ID NO: 4160 - DNA, 14 bp, Artificial sequence
  synthetic sequence
tccacgcgctgcac

SEQ ID NO: 4161 - DNA, 14 bp, Artificial sequence
  synthetic sequence
tctaagcgcgcgag

SEQ ID NO: 4162 - DNA, 14 bp, Artificial sequence
  synthetic sequence
gggggaactaggtg

SEQ ID NO: 4163 - DNA, 14 bp, Artificial sequence
  synthetic sequence
aggcgcagaataat

SEQ ID NO: 4164 - DNA, 14 bp, Artificial sequence
  synthetic sequence
atcaccaagtccgg

SEQ ID NO: 4165 - DNA, 14 bp, Artificial sequence
  synthetic sequence
cacagtacgaagat

SEQ ID NO: 4166 - DNA, 14 bp, Artificial sequence
  synthetic sequence
gcgcaaccgttaac

SEQ ID NO: 4167 - DNA, 14 bp, Artificial sequence
  synthetic sequence
ccccatacccacgt

SEQ ID NO: 4168 - DNA, 14 bp, Artificial sequence
  synthetic sequence
ggttagaagccccg

SEQ ID NO: 4169 - DNA, 14 bp, Artificial sequence
  synthetic sequence
cgcccatgccgtag

SEQ ID NO: 4170 - DNA, 14 bp, Artificial sequence
  synthetic sequence
ctgcaccactggga

SEQ ID NO: 4171 - DNA, 14 bp, Artificial sequence
  synthetic sequence
cagcgggtcgatca

SEQ ID NO: 4172 - DNA, 14 bp, Artificial sequence
  synthetic sequence
agggcacaccttcg

SEQ ID NO: 4173 - DNA, 14 bp, Artificial sequence
  synthetic sequence
gagtgggcagcggt

SEQ ID NO: 4174 - DNA, 14 bp, Artificial sequence
  synthetic sequence
aacaactccgtggc

SEQ ID NO: 4175 - DNA, 14 bp, Artificial sequence
  synthetic sequence
tgtaaagcccccgc

SEQ ID NO: 4176 - DNA, 14 bp, Artificial sequence
  synthetic sequence
gcacacgtaaagtg

SEQ ID NO: 4177 - DNA, 14 bp, Artificial sequence
  synthetic sequence
aacggcctcctcgc

SEQ ID NO: 4178 - DNA, 14 bp, Artificial sequence
  synthetic sequence
ctccgctacgcgaa

SEQ ID NO: 4179 - DNA, 14 bp, Artificial sequence
  synthetic sequence
actgaaccactgga

SEQ ID NO: 4180 - DNA, 14 bp, Artificial sequence
  synthetic sequence
agacggtccggtag

SEQ ID NO: 4181 - DNA, 14 bp, Artificial sequence
  synthetic sequence
agggtagtgagcgg

SEQ ID NO: 4182 - DNA, 14 bp, Artificial sequence
  synthetic sequence
ggagcgctgcatcc

SEQ ID NO: 4183 - DNA, 14 bp, Artificial sequence
  synthetic sequence
ttacccaggcaaaa

SEQ ID NO: 4184 - DNA, 14 bp, Artificial sequence
  synthetic sequence
gtcagagataccgc

SEQ ID NO: 4185 - DNA, 14 bp, Artificial sequence
  synthetic sequence
agcggaggtacggt

SEQ ID NO: 4186 - DNA, 14 bp, Artificial sequence
  synthetic sequence
ctccgagctaggac

SEQ ID NO: 4187 - DNA, 14 bp, Artificial sequence
  synthetic sequence
ccaaagatagatca

SEQ ID NO: 4188 - DNA, 14 bp, Artificial sequence
  synthetic sequence
gggcgaaaggtact

SEQ ID NO: 4189 - DNA, 14 bp, Artificial sequence
  synthetic sequence
gttgcagggaaccc

SEQ ID NO: 4190 - DNA, 14 bp, Artificial sequence
  synthetic sequence
gtctggcagcagaa

SEQ ID NO: 4191 - DNA, 14 bp, Artificial sequence
  synthetic sequence
tcggagaacgtgag

SEQ ID NO: 4192 - DNA, 14 bp, Artificial sequence
  synthetic sequence
cggtggagcgctca

SEQ ID NO: 4193 - DNA, 14 bp, Artificial sequence
  synthetic sequence
gagcgccttagcac

SEQ ID NO: 4194 - DNA, 14 bp, Artificial sequence
  synthetic sequence
tggccagagtcgcc

SEQ ID NO: 4195 - DNA, 14 bp, Artificial sequence
  synthetic sequence
gcaagtcggcgctc

SEQ ID NO: 4196 - DNA, 14 bp, Artificial sequence
  synthetic sequence
cccaatcgtaggaa

SEQ ID NO: 4197 - DNA, 14 bp, Artificial sequence
  synthetic sequence
cgtggggaacggct

SEQ ID NO: 4198 - DNA, 14 bp, Artificial sequence
  synthetic sequence
accaccgactggat

SEQ ID NO: 4199 - DNA, 14 bp, Artificial sequence
  synthetic sequence
caaccagcgattag

SEQ ID NO: 4200 - DNA, 14 bp, Artificial sequence
  synthetic sequence
ggcaccctctgaac

SEQ ID NO: 4201 - DNA, 14 bp, Artificial sequence
  synthetic sequence
taaaaagacgcgta

SEQ ID NO: 4202 - DNA, 14 bp, Artificial sequence
  synthetic sequence
accagccagctcat

SEQ ID NO: 4203 - DNA, 14 bp, Artificial sequence
  synthetic sequence
gacaacgggtgtgc

SEQ ID NO: 4204 - DNA, 14 bp, Artificial sequence
  synthetic sequence
ctagcccaatccga

SEQ ID NO: 4205 - DNA, 14 bp, Artificial sequence
  synthetic sequence
ctatccaaacgagc

SEQ ID NO: 4206 - DNA, 14 bp, Artificial sequence
  synthetic sequence
gaagcgtacgctcc

SEQ ID NO: 4207 - DNA, 14 bp, Artificial sequence
  synthetic sequence
acgttcgcaggaaa

SEQ ID NO: 4208 - DNA, 14 bp, Artificial sequence
  synthetic sequence
gaatgacgataagg

SEQ ID NO: 4209 - DNA, 14 bp, Artificial sequence
  synthetic sequence
gaaataacgatcag

SEQ ID NO: 4210 - DNA, 14 bp, Artificial sequence
  synthetic sequence
caatgcaacatggc

SEQ ID NO: 4211 - DNA, 14 bp, Artificial sequence
  synthetic sequence
ctacaacggctgcg

SEQ ID NO: 4212 - DNA, 14 bp, Artificial sequence
  synthetic sequence
tcacaatatgacac

SEQ ID NO: 4213 - DNA, 14 bp, Artificial sequence
  synthetic sequence
ctattgcgggagaa

SEQ ID NO: 4214 - DNA, 14 bp, Artificial sequence
  synthetic sequence
gagatccgctgtac

SEQ ID NO: 4215 - DNA, 14 bp, Artificial sequence
  synthetic sequence
aaatcgatggcgct

SEQ ID NO: 4216 - DNA, 14 bp, Artificial sequence
  synthetic sequence
tcacgagatccgta

SEQ ID NO: 4217 - DNA, 14 bp, Artificial sequence
  synthetic sequence
ctatgccgggccat

SEQ ID NO: 4218 - DNA, 14 bp, Artificial sequence
  synthetic sequence
tagtccctacggac

SEQ ID NO: 4219 - DNA, 14 bp, Artificial sequence
  synthetic sequence
aggatgagttggcg

SEQ ID NO: 4220 - DNA, 14 bp, Artificial sequence
  synthetic sequence
gcggctgtgaacct

SEQ ID NO: 4221 - DNA, 14 bp, Artificial sequence
  synthetic sequence
ttgagcgaaggtca

SEQ ID NO: 4222 - DNA, 14 bp, Artificial sequence
  synthetic sequence
gtatcccggataga

SEQ ID NO: 4223 - DNA, 14 bp, Artificial sequence
  synthetic sequence
aacgccatatcgct

SEQ ID NO: 4224 - DNA, 14 bp, Artificial sequence
  synthetic sequence
tctataacggcaga

SEQ ID NO: 4225 - DNA, 14 bp, Artificial sequence
  synthetic sequence
gctcactgactacg

SEQ ID NO: 4226 - DNA, 14 bp, Artificial sequence
  synthetic sequence
cgtcgcacaattcg

SEQ ID NO: 4227 - DNA, 14 bp, Artificial sequence
  synthetic sequence
agtagagtaatgcc

SEQ ID NO: 4228 - DNA, 14 bp, Artificial sequence
  synthetic sequence
gtgctcataacaaa

SEQ ID NO: 4229 - DNA, 14 bp, Artificial sequence
  synthetic sequence
gggttgcaagaact

SEQ ID NO: 4230 - DNA, 14 bp, Artificial sequence
  synthetic sequence
cctgacattcccca

SEQ ID NO: 4231 - DNA, 14 bp, Artificial sequence
  synthetic sequence
ggcaattccgatca

SEQ ID NO: 4232 - DNA, 14 bp, Artificial sequence
  synthetic sequence
gcacagtatctcga

SEQ ID NO: 4233 - DNA, 14 bp, Artificial sequence
  synthetic sequence
aggggctatgtcgc

SEQ ID NO: 4234 - DNA, 14 bp, Artificial sequence
  synthetic sequence
gcgctggaagtagt

SEQ ID NO: 4235 - DNA, 14 bp, Artificial sequence
  synthetic sequence
tcgtgtcgacgcca

SEQ ID NO: 4236 - DNA, 14 bp, Artificial sequence
  synthetic sequence
ctaccattgccgga

SEQ ID NO: 4237 - DNA, 14 bp, Artificial sequence
  synthetic sequence
cactgcaatcaaat

SEQ ID NO: 4238 - DNA, 14 bp, Artificial sequence
  synthetic sequence
aagtcaccttagag

SEQ ID NO: 4239 - DNA, 14 bp, Artificial sequence
  synthetic sequence
aaggcattataacg

SEQ ID NO: 4240 - DNA, 14 bp, Artificial sequence
  synthetic sequence
acctagaccgcttc

SEQ ID NO: 4241 - DNA, 14 bp, Artificial sequence
  synthetic sequence
agcggactagtcgt

SEQ ID NO: 4242 - DNA, 14 bp, Artificial sequence
  synthetic sequence
tggactcacgtccc

SEQ ID NO: 4243 - DNA, 14 bp, Artificial sequence
  synthetic sequence
atagtccgcctaga

SEQ ID NO: 4244 - DNA, 14 bp, Artificial sequence
  synthetic sequence
cattcaccccgtca

SEQ ID NO: 4245 - DNA, 14 bp, Artificial sequence
  synthetic sequence
ttagcaccggtgcc

SEQ ID NO: 4246 - DNA, 14 bp, Artificial sequence
  synthetic sequence
ccatgacccttcaa

SEQ ID NO: 4247 - DNA, 14 bp, Artificial sequence
  synthetic sequence
atcagttcaacgcc

SEQ ID NO: 4248 - DNA, 14 bp, Artificial sequence
  synthetic sequence
ccacatatcgcgta

SEQ ID NO: 4249 - DNA, 14 bp, Artificial sequence
  synthetic sequence
aaagactcaattag

SEQ ID NO: 4250 - DNA, 14 bp, Artificial sequence
  synthetic sequence
gtccggattaaaaa

SEQ ID NO: 4251 - DNA, 14 bp, Artificial sequence
  synthetic sequence
ttacgctcggaagg

SEQ ID NO: 4252 - DNA, 14 bp, Artificial sequence
  synthetic sequence
atcgccgtcactac

SEQ ID NO: 4253 - DNA, 14 bp, Artificial sequence
  synthetic sequence
cgtgcccttagcaa

SEQ ID NO: 4254 - DNA, 14 bp, Artificial sequence
  synthetic sequence
ccaaattcggatga

SEQ ID NO: 4255 - DNA, 14 bp, Artificial sequence
  synthetic sequence
cctacacctagagt

SEQ ID NO: 4256 - DNA, 14 bp, Artificial sequence
  synthetic sequence
cacgatttggagaa

SEQ ID NO: 4257 - DNA, 14 bp, Artificial sequence
  synthetic sequence
cctcagagtagtgg

SEQ ID NO: 4258 - DNA, 14 bp, Artificial sequence
  synthetic sequence
tatcgcaacagatc

SEQ ID NO: 4259 - DNA, 14 bp, Artificial sequence
  synthetic sequence
cagcgctgggttaa

SEQ ID NO: 4260 - DNA, 14 bp, Artificial sequence
  synthetic sequence
cgatccgatgtcca

SEQ ID NO: 4261 - DNA, 14 bp, Artificial sequence
  synthetic sequence
ccattcgatacaaa

SEQ ID NO: 4262 - DNA, 14 bp, Artificial sequence
  synthetic sequence
atcacaaatatgga

SEQ ID NO: 4263 - DNA, 14 bp, Artificial sequence
  synthetic sequence
cgaatagcttcccg

SEQ ID NO: 4264 - DNA, 14 bp, Artificial sequence
  synthetic sequence
cggaatttgggaca

SEQ ID NO: 4265 - DNA, 14 bp, Artificial sequence
  synthetic sequence
gaggctcggtctgg

SEQ ID NO: 4266 - DNA, 14 bp, Artificial sequence
  synthetic sequence
ggtatcgaggctaa

SEQ ID NO: 4267 - DNA, 14 bp, Artificial sequence
  synthetic sequence
catgtaaaacgtag

SEQ ID NO: 4268 - DNA, 14 bp, Artificial sequence
  synthetic sequence
atgtacagcaaatg

SEQ ID NO: 4269 - DNA, 14 bp, Artificial sequence
  synthetic sequence
ccaccgtgatatct

SEQ ID NO: 4270 - DNA, 14 bp, Artificial sequence
  synthetic sequence
tcgagaagactttc

SEQ ID NO: 4271 - DNA, 14 bp, Artificial sequence
  synthetic sequence
ccctggttaccagt

SEQ ID NO: 4272 - DNA, 14 bp, Artificial sequence
  synthetic sequence
gcttatcccgagat

SEQ ID NO: 4273 - DNA, 14 bp, Artificial sequence
  synthetic sequence
gggagtggcttctg

SEQ ID NO: 4274 - DNA, 14 bp, Artificial sequence
  synthetic sequence
aaggacggtctatt

SEQ ID NO: 4275 - DNA, 14 bp, Artificial sequence
  synthetic sequence
ttatcacgagcgct

SEQ ID NO: 4276 - DNA, 14 bp, Artificial sequence
  synthetic sequence
agtaacgttgatca

SEQ ID NO: 4277 - DNA, 14 bp, Artificial sequence
  synthetic sequence
ccttagtatgcaaa

SEQ ID NO: 4278 - DNA, 14 bp, Artificial sequence
  synthetic sequence
ccagtatgtgggat

SEQ ID NO: 4279 - DNA, 14 bp, Artificial sequence
  synthetic sequence
ttagtaacagactc

SEQ ID NO: 4280 - DNA, 14 bp, Artificial sequence
  synthetic sequence
gcaggttcaccgtt

SEQ ID NO: 4281 - DNA, 14 bp, Artificial sequence
  synthetic sequence
gtgctctactgcac

SEQ ID NO: 4282 - DNA, 14 bp, Artificial sequence
  synthetic sequence
acatatgcgctcgt

SEQ ID NO: 4283 - DNA, 14 bp, Artificial sequence
  synthetic sequence
attgtaatgcccca

SEQ ID NO: 4284 - DNA, 14 bp, Artificial sequence
  synthetic sequence
acacgctgtaactt

SEQ ID NO: 4285 - DNA, 14 bp, Artificial sequence
  synthetic sequence
gacaccattgctgt

SEQ ID NO: 4286 - DNA, 14 bp, Artificial sequence
  synthetic sequence
gcagtctatgtaac

SEQ ID NO: 4287 - DNA, 14 bp, Artificial sequence
  synthetic sequence
ttagagatgacggt

SEQ ID NO: 4288 - DNA, 14 bp, Artificial sequence
  synthetic sequence
tcttagaccaaact

SEQ ID NO: 4289 - DNA, 14 bp, Artificial sequence
  synthetic sequence
acgcggtaataatt

SEQ ID NO: 4290 - DNA, 14 bp, Artificial sequence
  synthetic sequence
ttcgctactagggc

SEQ ID NO: 4291 - DNA, 14 bp, Artificial sequence
  synthetic sequence
cgattgcggactct

SEQ ID NO: 4292 - DNA, 14 bp, Artificial sequence
  synthetic sequence
gatatagcaactgt

SEQ ID NO: 4293 - DNA, 14 bp, Artificial sequence
  synthetic sequence
cctaatgcccggtt

SEQ ID NO: 4294 - DNA, 14 bp, Artificial sequence
  synthetic sequence
agaggtcggtttac

SEQ ID NO: 4295 - DNA, 14 bp, Artificial sequence
  synthetic sequence
ttacaaatcgctgg

SEQ ID NO: 4296 - DNA, 14 bp, Artificial sequence
  synthetic sequence
cttatgataccaac

SEQ ID NO: 4297 - DNA, 14 bp, Artificial sequence
  synthetic sequence
gatgtcgtggtcca

SEQ ID NO: 4298 - DNA, 14 bp, Artificial sequence
  synthetic sequence
atcttcctgccaca

SEQ ID NO: 4299 - DNA, 14 bp, Artificial sequence
  synthetic sequence
gaccttgctatcag

SEQ ID NO: 4300 - DNA, 14 bp, Artificial sequence
  synthetic sequence
tccacaatcttaaa

SEQ ID NO: 4301 - DNA, 14 bp, Artificial sequence
  synthetic sequence
agtgagttcccatg

SEQ ID NO: 4302 - DNA, 14 bp, Artificial sequence
  synthetic sequence
gttcttagcgaggc

SEQ ID NO: 4303 - DNA, 14 bp, Artificial sequence
  synthetic sequence
taccagatgggtgt

SEQ ID NO: 4304 - DNA, 14 bp, Artificial sequence
  synthetic sequence
gcattcgggtataa

SEQ ID NO: 4305 - DNA, 14 bp, Artificial sequence
  synthetic sequence
cagtacccttcata

SEQ ID NO: 4306 - DNA, 14 bp, Artificial sequence
  synthetic sequence
gcagccatccattt

SEQ ID NO: 4307 - DNA, 14 bp, Artificial sequence
  synthetic sequence
ggccactgtttaaa

SEQ ID NO: 4308 - DNA, 14 bp, Artificial sequence
  synthetic sequence
gcatcatgtaaaat

SEQ ID NO: 4309 - DNA, 14 bp, Artificial sequence
  synthetic sequence
tacgtgtgtacagc

SEQ ID NO: 4310 - DNA, 14 bp, Artificial sequence
  synthetic sequence
tatactgccgcatg

SEQ ID NO: 4311 - DNA, 14 bp, Artificial sequence
  synthetic sequence
catcatcgcttacg

SEQ ID NO: 4312 - DNA, 14 bp, Artificial sequence
  synthetic sequence
cccaatatacttac

SEQ ID NO: 4313 - DNA, 14 bp, Artificial sequence
  synthetic sequence
tctcaattcgcgaa

SEQ ID NO: 4314 - DNA, 14 bp, Artificial sequence
  synthetic sequence
gataattctgcgaa

SEQ ID NO: 4315 - DNA, 14 bp, Artificial sequence
  synthetic sequence
cgcttgtaagagtc

SEQ ID NO: 4316 - DNA, 14 bp, Artificial sequence
  synthetic sequence
atcgggttaagatg

SEQ ID NO: 4317 - DNA, 14 bp, Artificial sequence
  synthetic sequence
gggctcacggattt

SEQ ID NO: 4318 - DNA, 14 bp, Artificial sequence
  synthetic sequence
tatgtcgcgaatag

SEQ ID NO: 4319 - DNA, 14 bp, Artificial sequence
  synthetic sequence
actgactcctgatg

SEQ ID NO: 4320 - DNA, 14 bp, Artificial sequence
  synthetic sequence
ctgtttacaggcga

SEQ ID NO: 4321 - DNA, 14 bp, Artificial sequence
  synthetic sequence
gccaatcttcagtc

SEQ ID NO: 4322 - DNA, 14 bp, Artificial sequence
  synthetic sequence
tcacgcgtaattcc

SEQ ID NO: 4323 - DNA, 14 bp, Artificial sequence
  synthetic sequence
actggttacccaat

SEQ ID NO: 4324 - DNA, 14 bp, Artificial sequence
  synthetic sequence
tgcgtagttaagga

SEQ ID NO: 4325 - DNA, 14 bp, Artificial sequence
  synthetic sequence
cgcctcgatcttga

SEQ ID NO: 4326 - DNA, 14 bp, Artificial sequence
  synthetic sequence
tggtcgtcccggtg

SEQ ID NO: 4327 - DNA, 14 bp, Artificial sequence
  synthetic sequence
gtggttgtcccggc

SEQ ID NO: 4328 - DNA, 14 bp, Artificial sequence
  synthetic sequence
tacggacccgtatt

SEQ ID NO: 4329 - DNA, 14 bp, Artificial sequence
  synthetic sequence
tgccatctggatgg

SEQ ID NO: 4330 - DNA, 14 bp, Artificial sequence
  synthetic sequence
cggcttctccctgc

SEQ ID NO: 4331 - DNA, 14 bp, Artificial sequence
  synthetic sequence
cggtatgcttaaca

SEQ ID NO: 4332 - DNA, 14 bp, Artificial sequence
  synthetic sequence
ggggaggttttcag

SEQ ID NO: 4333 - DNA, 14 bp, Artificial sequence
  synthetic sequence
acggtggtactgct

SEQ ID NO: 4334 - DNA, 14 bp, Artificial sequence
  synthetic sequence
aatcacattgggct

SEQ ID NO: 4335 - DNA, 14 bp, Artificial sequence
  synthetic sequence
tcgtactccgtcac

SEQ ID NO: 4336 - DNA, 14 bp, Artificial sequence
  synthetic sequence
ttcccgctcgtaaa

SEQ ID NO: 4337 - DNA, 14 bp, Artificial sequence
  synthetic sequence
tcgcaaattaatgc

SEQ ID NO: 4338 - DNA, 14 bp, Artificial sequence
  synthetic sequence
caccgttccttcgg

SEQ ID NO: 4339 - DNA, 14 bp, Artificial sequence
  synthetic sequence
ggtcctaggtgact

SEQ ID NO: 4340 - DNA, 14 bp, Artificial sequence
  synthetic sequence
caacattcttaaag

SEQ ID NO: 4341 - DNA, 14 bp, Artificial sequence
  synthetic sequence
gcacttaattatcc

SEQ ID NO: 4342 - DNA, 14 bp, Artificial sequence
  synthetic sequence
catacgcatgtctt

SEQ ID NO: 4343 - DNA, 14 bp, Artificial sequence
  synthetic sequence
cactgttttgcaga

SEQ ID NO: 4344 - DNA, 14 bp, Artificial sequence
  synthetic sequence
ttacccggattcgt

SEQ ID NO: 4345 - DNA, 14 bp, Artificial sequence
  synthetic sequence
ctggtgctaatcat

SEQ ID NO: 4346 - DNA, 14 bp, Artificial sequence
  synthetic sequence
tgcctatctcagtc

SEQ ID NO: 4347 - DNA, 14 bp, Artificial sequence
  synthetic sequence
tgactaatcgtgta

SEQ ID NO: 4348 - DNA, 14 bp, Artificial sequence
  synthetic sequence
ccgatatcatgttc

SEQ ID NO: 4349 - DNA, 14 bp, Artificial sequence
  synthetic sequence
gtaggagttctctg

SEQ ID NO: 4350 - DNA, 14 bp, Artificial sequence
  synthetic sequence
gatagccttcatta

SEQ ID NO: 4351 - DNA, 14 bp, Artificial sequence
  synthetic sequence
tgcttagcaaatat

SEQ ID NO: 4352 - DNA, 14 bp, Artificial sequence
  synthetic sequence
acctctaatgttcg

SEQ ID NO: 4353 - DNA, 14 bp, Artificial sequence
  synthetic sequence
tcataccggacttt

SEQ ID NO: 4354 - DNA, 14 bp, Artificial sequence
  synthetic sequence
gtgtatatctaaac

SEQ ID NO: 4355 - DNA, 14 bp, Artificial sequence
  synthetic sequence
tgaaccagctattt

SEQ ID NO: 4356 - DNA, 14 bp, Artificial sequence
  synthetic sequence
cgttttggccagat

SEQ ID NO: 4357 - DNA, 14 bp, Artificial sequence
  synthetic sequence
ttctaatatgagaa

SEQ ID NO: 4358 - DNA, 14 bp, Artificial sequence
  synthetic sequence
gtctactcggttag

SEQ ID NO: 4359 - DNA, 14 bp, Artificial sequence
  synthetic sequence
aatattacagtcct

SEQ ID NO: 4360 - DNA, 14 bp, Artificial sequence
  synthetic sequence
taacagaagttgtt

SEQ ID NO: 4361 - DNA, 14 bp, Artificial sequence
  synthetic sequence
tcatcgatacttgg

SEQ ID NO: 4362 - DNA, 14 bp, Artificial sequence
  synthetic sequence
ttcccgattgcgat

SEQ ID NO: 4363 - DNA, 14 bp, Artificial sequence
  synthetic sequence
ctctcgggctttgc

SEQ ID NO: 4364 - DNA, 14 bp, Artificial sequence
  synthetic sequence
cttcggctgggatt

SEQ ID NO: 4365 - DNA, 14 bp, Artificial sequence
  synthetic sequence
ccgaggttgtgatt

SEQ ID NO: 4366 - DNA, 14 bp, Artificial sequence
  synthetic sequence
ctttgcagttgggg

SEQ ID NO: 4367 - DNA, 14 bp, Artificial sequence
  synthetic sequence
tgttatccgggatc

SEQ ID NO: 4368 - DNA, 14 bp, Artificial sequence
  synthetic sequence
atgtagtaagttca

SEQ ID NO: 4369 - DNA, 14 bp, Artificial sequence
  synthetic sequence
aagacgtttgctct

SEQ ID NO: 4370 - DNA, 14 bp, Artificial sequence
  synthetic sequence
gtggatcttataga

SEQ ID NO: 4371 - DNA, 14 bp, Artificial sequence
  synthetic sequence
atctggggacattt

SEQ ID NO: 4372 - DNA, 14 bp, Artificial sequence
  synthetic sequence
cgttcctctgcctc

SEQ ID NO: 4373 - DNA, 14 bp, Artificial sequence
  synthetic sequence
aatacctctctcta

SEQ ID NO: 4374 - DNA, 14 bp, Artificial sequence
  synthetic sequence
cgtcgcttcgttag

SEQ ID NO: 4375 - DNA, 14 bp, Artificial sequence
  synthetic sequence
tgaccttatccgtg

SEQ ID NO: 4376 - DNA, 14 bp, Artificial sequence
  synthetic sequence
tgcccattgatggt

SEQ ID NO: 4377 - DNA, 14 bp, Artificial sequence
  synthetic sequence
ggtgatgccttaat

SEQ ID NO: 4378 - DNA, 14 bp, Artificial sequence
  synthetic sequence
tgtggaatccgctt

SEQ ID NO: 4379 - DNA, 14 bp, Artificial sequence
  synthetic sequence
ccattaatcctaat

SEQ ID NO: 4380 - DNA, 14 bp, Artificial sequence
  synthetic sequence
tcaacgaaattatt

SEQ ID NO: 4381 - DNA, 14 bp, Artificial sequence
  synthetic sequence
ccgctctttgggta

SEQ ID NO: 4382 - DNA, 14 bp, Artificial sequence
  synthetic sequence
cttgccatgagatt

SEQ ID NO: 4383 - DNA, 14 bp, Artificial sequence
  synthetic sequence
gtattgcagcttcc

SEQ ID NO: 4384 - DNA, 14 bp, Artificial sequence
  synthetic sequence
ttctactgtagact

SEQ ID NO: 4385 - DNA, 14 bp, Artificial sequence
  synthetic sequence
gtcggcctttgttc

SEQ ID NO: 4386 - DNA, 14 bp, Artificial sequence
  synthetic sequence
catgacttctgtct

SEQ ID NO: 4387 - DNA, 14 bp, Artificial sequence
  synthetic sequence
atgctgtctctgct

SEQ ID NO: 4388 - DNA, 14 bp, Artificial sequence
  synthetic sequence
tggcgagtttttgc

SEQ ID NO: 4389 - DNA, 14 bp, Artificial sequence
  synthetic sequence
attcgttatctgcc

SEQ ID NO: 4390 - DNA, 14 bp, Artificial sequence
  synthetic sequence
tttttgaactgggc

SEQ ID NO: 4391 - DNA, 14 bp, Artificial sequence
  synthetic sequence
cttcggagcttttg

SEQ ID NO: 4392 - DNA, 14 bp, Artificial sequence
  synthetic sequence
cgtgatattattga

SEQ ID NO: 4393 - DNA, 14 bp, Artificial sequence
  synthetic sequence
ctatcggtagttat

SEQ ID NO: 4394 - DNA, 14 bp, Artificial sequence
  synthetic sequence
ctattagtttgagg

SEQ ID NO: 4395 - DNA, 14 bp, Artificial sequence
  synthetic sequence
ttaactctccgtgt

SEQ ID NO: 4396 - DNA, 14 bp, Artificial sequence
  synthetic sequence
tgcttctgagttaa

SEQ ID NO: 4397 - DNA, 14 bp, Artificial sequence
  synthetic sequence
tctcacgttagttc

SEQ ID NO: 4398 - DNA, 14 bp, Artificial sequence
  synthetic sequence
cctgtattgtacta

SEQ ID NO: 4399 - DNA, 14 bp, Artificial sequence
  synthetic sequence
gtcattatatctag

SEQ ID NO: 4400 - DNA, 14 bp, Artificial sequence
  synthetic sequence
tttattgatgaggg

SEQ ID NO: 4401 - DNA, 14 bp, Artificial sequence
  synthetic sequence
ttgtatttcaacga

SEQ ID NO: 4402 - DNA, 14 bp, Artificial sequence
  synthetic sequence
aaactatttctgta

SEQ ID NO: 4403 - DNA, 14 bp, Artificial sequence
  synthetic sequence
atttctcaagtctc

SEQ ID NO: 4404 - DNA, 14 bp, Artificial sequence
  synthetic sequence
cctgatgtatactt

SEQ ID NO: 4405 - DNA, 14 bp, Artificial sequence
  synthetic sequence
attaactatgtgat

SEQ ID NO: 4406 - DNA, 14 bp, Artificial sequence
  synthetic sequence
atgtggtgtaattc

SEQ ID NO: 4407 - DNA, 14 bp, Artificial sequence
  synthetic sequence
tattcacacttatc

SEQ ID NO: 4408 - DNA, 14 bp, Artificial sequence
  synthetic sequence
ttctattgcgctcg

SEQ ID NO: 4409 - DNA, 14 bp, Artificial sequence
  synthetic sequence
ttcatataccatta

SEQ ID NO: 4410 - DNA, 14 bp, Artificial sequence
  synthetic sequence
ctgtccttctggta

SEQ ID NO: 4411 - DNA, 14 bp, Artificial sequence
  synthetic sequence
tttaacagtcttgc

SEQ ID NO: 4412 - DNA, 14 bp, Artificial sequence
  synthetic sequence
cgtatttaaggttg

SEQ ID NO: 4413 - DNA, 14 bp, Artificial sequence
  synthetic sequence
ctagggatttgtat

SEQ ID NO: 4414 - DNA, 14 bp, Artificial sequence
  synthetic sequence
cgtctattttgaca

SEQ ID NO: 4415 - DNA, 14 bp, Artificial sequence
  synthetic sequence
cgtaccttcttcgt

SEQ ID NO: 4416 - DNA, 14 bp, Artificial sequence
  synthetic sequence
cttacatgaaattt

SEQ ID NO: 4417 - DNA, 14 bp, Artificial sequence
  synthetic sequence
taattaggttgtca

SEQ ID NO: 4418 - DNA, 14 bp, Artificial sequence
  synthetic sequence
ttatatttaggccc

SEQ ID NO: 4419 - DNA, 14 bp, Artificial sequence
  synthetic sequence
ctttgtgtcaacat

SEQ ID NO: 4420 - DNA, 14 bp, Artificial sequence
  synthetic sequence
tctggttgtgcact

SEQ ID NO: 4421 - DNA, 14 bp, Artificial sequence
  synthetic sequence
ctaacatgtctatt

SEQ ID NO: 4422 - DNA, 14 bp, Artificial sequence
  synthetic sequence
ctagtattctgtcc

SEQ ID NO: 4423 - DNA, 14 bp, Artificial sequence
  synthetic sequence
taagactatgcttt

SEQ ID NO: 4424 - DNA, 14 bp, Artificial sequence
  synthetic sequence
ttctgtatgaacct

SEQ ID NO: 4425 - DNA, 14 bp, Artificial sequence
  synthetic sequence
atgttgcatactta

SEQ ID NO: 4426 - DNA, 14 bp, Artificial sequence
  synthetic sequence
cagtttattcatac

SEQ ID NO: 4427 - DNA, 14 bp, Artificial sequence
  synthetic sequence
cgacccaagagaaa

SEQ ID NO: 4428 - DNA, 14 bp, Artificial sequence
  synthetic sequence
aaacccacgaaacg

SEQ ID NO: 4429 - DNA, 14 bp, Artificial sequence
  synthetic sequence
gaacgcgagccgga

SEQ ID NO: 4430 - DNA, 14 bp, Artificial sequence
  synthetic sequence
cacgcaaaagagga

SEQ ID NO: 4431 - DNA, 14 bp, Artificial sequence
  synthetic sequence
gcggcacacgagga

SEQ ID NO: 4432 - DNA, 14 bp, Artificial sequence
  synthetic sequence
aggacgcagccaca

SEQ ID NO: 4433 - DNA, 14 bp, Artificial sequence
  synthetic sequence
ggaacgggcagaag

SEQ ID NO: 4434 - DNA, 14 bp, Artificial sequence
  synthetic sequence
ccacggaggaaggc

SEQ ID NO: 4435 - DNA, 14 bp, Artificial sequence
  synthetic sequence
ccgacacaagagcg

SEQ ID NO: 4436 - DNA, 14 bp, Artificial sequence
  synthetic sequence
ggagggggagaccc

SEQ ID NO: 4437 - DNA, 14 bp, Artificial sequence
  synthetic sequence
aagcagccggggcc

SEQ ID NO: 4438 - DNA, 14 bp, Artificial sequence
  synthetic sequence
cgccagccaggaac

SEQ ID NO: 4439 - DNA, 14 bp, Artificial sequence
  synthetic sequence
aggacggcaggcag

SEQ ID NO: 4440 - DNA, 14 bp, Artificial sequence
  synthetic sequence
cacgaccaaccagg

SEQ ID NO: 4441 - DNA, 14 bp, Artificial sequence
  synthetic sequence
cagccagcaccccc

SEQ ID NO: 4442 - DNA, 14 bp, Artificial sequence
  synthetic sequence
acccacgagagcaa

SEQ ID NO: 4443 - DNA, 14 bp, Artificial sequence
  synthetic sequence
gggcaaggagggac

SEQ ID NO: 4444 - DNA, 14 bp, Artificial sequence
  synthetic sequence
accggaggggaggc

SEQ ID NO: 4445 - DNA, 14 bp, Artificial sequence
  synthetic sequence
gcgagaacgccgac

SEQ ID NO: 4446 - DNA, 14 bp, Artificial sequence
  synthetic sequence
cgaggagagcagca

SEQ ID NO: 4447 - DNA, 14 bp, Artificial sequence
  synthetic sequence
aaaccgagccagga

SEQ ID NO: 4448 - DNA, 14 bp, Artificial sequence
  synthetic sequence
caccacgcgacacg

SEQ ID NO: 4449 - DNA, 14 bp, Artificial sequence
  synthetic sequence
caaaaacgcgagga

SEQ ID NO: 4450 - DNA, 14 bp, Artificial sequence
  synthetic sequence
aagaaaagacgccg

SEQ ID NO: 4451 - DNA, 14 bp, Artificial sequence
  synthetic sequence
gcacaaaacagcag

SEQ ID NO: 4452 - DNA, 14 bp, Artificial sequence
  synthetic sequence
ccccaagggaggag

SEQ ID NO: 4453 - DNA, 14 bp, Artificial sequence
  synthetic sequence
aacaacgagcagcc

SEQ ID NO: 4454 - DNA, 14 bp, Artificial sequence
  synthetic sequence
ccagagaaaaaccc

SEQ ID NO: 4455 - DNA, 14 bp, Artificial sequence
  synthetic sequence
acggaagaaaaaag

SEQ ID NO: 4456 - DNA, 14 bp, Artificial sequence
  synthetic sequence
ggaaagcgcacaga

SEQ ID NO: 4457 - DNA, 14 bp, Artificial sequence
  synthetic sequence
accaaaaacagacg

SEQ ID NO: 4458 - DNA, 14 bp, Artificial sequence
  synthetic sequence
aaaccaacagaaac

SEQ ID NO: 4459 - DNA, 14 bp, Artificial sequence
  synthetic sequence
gacggacggcaggg

SEQ ID NO: 4460 - DNA, 14 bp, Artificial sequence
  synthetic sequence
gggaaagaagcgcg

SEQ ID NO: 4461 - DNA, 14 bp, Artificial sequence
  synthetic sequence
ccacggaggccaaa

SEQ ID NO: 4462 - DNA, 14 bp, Artificial sequence
  synthetic sequence
cggaacccacccaa

SEQ ID NO: 4463 - DNA, 14 bp, Artificial sequence
  synthetic sequence
aaaacggcaaaaag

SEQ ID NO: 4464 - DNA, 14 bp, Artificial sequence
  synthetic sequence
gcctgaggcgacac

SEQ ID NO: 4465 - DNA, 14 bp, Artificial sequence
  synthetic sequence
caggggtcccagcg

SEQ ID NO: 4466 - DNA, 14 bp, Artificial sequence
  synthetic sequence
gcgactaaaacacc

SEQ ID NO: 4467 - DNA, 14 bp, Artificial sequence
  synthetic sequence
gagaggggtaggga

SEQ ID NO: 4468 - DNA, 14 bp, Artificial sequence
  synthetic sequence
gagtcgcgaagagg

SEQ ID NO: 4469 - DNA, 14 bp, Artificial sequence
  synthetic sequence
aaggaatcaccgcc

SEQ ID NO: 4470 - DNA, 14 bp, Artificial sequence
  synthetic sequence
gaatgcaacgaacg

SEQ ID NO: 4471 - DNA, 14 bp, Artificial sequence
  synthetic sequence
cgcccaaaacagat

SEQ ID NO: 4472 - DNA, 14 bp, Artificial sequence
  synthetic sequence
gcagagcccgacgt

SEQ ID NO: 4473 - DNA, 14 bp, Artificial sequence
  synthetic sequence
gaccgaggacctgc

SEQ ID NO: 4474 - DNA, 14 bp, Artificial sequence
  synthetic sequence
agagtcccaagaac

SEQ ID NO: 4475 - DNA, 14 bp, Artificial sequence
  synthetic sequence
gaccgcacatcccc

SEQ ID NO: 4476 - DNA, 14 bp, Artificial sequence
  synthetic sequence
acagggaggtgcag

SEQ ID NO: 4477 - DNA, 14 bp, Artificial sequence
  synthetic sequence
catcggcaagcagc

SEQ ID NO: 4478 - DNA, 14 bp, Artificial sequence
  synthetic sequence
cggacatacgcacg

SEQ ID NO: 4479 - DNA, 14 bp, Artificial sequence
  synthetic sequence
ctgggaaagccaca

SEQ ID NO: 4480 - DNA, 14 bp, Artificial sequence
  synthetic sequence
ccaccccactaaag

SEQ ID NO: 4481 - DNA, 14 bp, Artificial sequence
  synthetic sequence
ccgccatcaggcac

SEQ ID NO: 4482 - DNA, 14 bp, Artificial sequence
  synthetic sequence
gaagagagataaaa

SEQ ID NO: 4483 - DNA, 14 bp, Artificial sequence
  synthetic sequence
gcagcggtcgaagg

SEQ ID NO: 4484 - DNA, 14 bp, Artificial sequence
  synthetic sequence
atcgaccagagggg

SEQ ID NO: 4485 - DNA, 14 bp, Artificial sequence
  synthetic sequence
aggcctcaaagaac

SEQ ID NO: 4486 - DNA, 14 bp, Artificial sequence
  synthetic sequence
ccaagcgtcgaagc

SEQ ID NO: 4487 - DNA, 14 bp, Artificial sequence
  synthetic sequence
accgacaactcgga

SEQ ID NO: 4488 - DNA, 14 bp, Artificial sequence
  synthetic sequence
ggaataaggagacc

SEQ ID NO: 4489 - DNA, 14 bp, Artificial sequence
  synthetic sequence
ctccgaccacccgc

SEQ ID NO: 4490 - DNA, 14 bp, Artificial sequence
  synthetic sequence
cgacgtccacaccc

SEQ ID NO: 4491 - DNA, 14 bp, Artificial sequence
  synthetic sequence
caaagcaccaataa

SEQ ID NO: 4492 - DNA, 14 bp, Artificial sequence
  synthetic sequence
ggtgcaggggcaag

SEQ ID NO: 4493 - DNA, 14 bp, Artificial sequence
  synthetic sequence
gcaagcagggggtg

SEQ ID NO: 4494 - DNA, 14 bp, Artificial sequence
  synthetic sequence
ccgggacagacgct

SEQ ID NO: 4495 - DNA, 14 bp, Artificial sequence
  synthetic sequence
caccgcgtcagcga

SEQ ID NO: 4496 - DNA, 14 bp, Artificial sequence
  synthetic sequence
caaaacctgaaccg

SEQ ID NO: 4497 - DNA, 14 bp, Artificial sequence
  synthetic sequence
gcacccatagggac

SEQ ID NO: 4498 - DNA, 14 bp, Artificial sequence
  synthetic sequence
ctacacacaagaag

SEQ ID NO: 4499 - DNA, 14 bp, Artificial sequence
  synthetic sequence
gtgcagagggacag

SEQ ID NO: 4500 - DNA, 14 bp, Artificial sequence
  synthetic sequence
caaaccccgatagg

SEQ ID NO: 4501 - DNA, 14 bp, Artificial sequence
  synthetic sequence
gggtacacgagacc

SEQ ID NO: 4502 - DNA, 14 bp, Artificial sequence
  synthetic sequence
cgaggtcacggccc

SEQ ID NO: 4503 - DNA, 14 bp, Artificial sequence
  synthetic sequence
gtgagaacacgagg

SEQ ID NO: 4504 - DNA, 14 bp, Artificial sequence
  synthetic sequence
caagagtcagacac

SEQ ID NO: 4505 - DNA, 14 bp, Artificial sequence
  synthetic sequence
cgagagtgacgcag

SEQ ID NO: 4506 - DNA, 14 bp, Artificial sequence
  synthetic sequence
cagagtcaacacaa

SEQ ID NO: 4507 - DNA, 14 bp, Artificial sequence
  synthetic sequence
ctaaaacaaaacgc

SEQ ID NO: 4508 - DNA, 14 bp, Artificial sequence
  synthetic sequence
aaacagggccatag

SEQ ID NO: 4509 - DNA, 14 bp, Artificial sequence
  synthetic sequence
aaaccagaccctgc

SEQ ID NO: 4510 - DNA, 14 bp, Artificial sequence
  synthetic sequence
cgaggggacagata

SEQ ID NO: 4511 - DNA, 14 bp, Artificial sequence
  synthetic sequence
agggaccagggtaa

SEQ ID NO: 4512 - DNA, 14 bp, Artificial sequence
  synthetic sequence
cagcctacgaggca

SEQ ID NO: 4513 - DNA, 14 bp, Artificial sequence
  synthetic sequence
acaccgaacgtgcc

SEQ ID NO: 4514 - DNA, 14 bp, Artificial sequence
  synthetic sequence
accgaccaatgccc

SEQ ID NO: 4515 - DNA, 14 bp, Artificial sequence
  synthetic sequence
ccacgacggtacga

SEQ ID NO: 4516 - DNA, 14 bp, Artificial sequence
  synthetic sequence
atgcaaggaaaaca

SEQ ID NO: 4517 - DNA, 14 bp, Artificial sequence
  synthetic sequence
gcagcgccactgcc

SEQ ID NO: 4518 - DNA, 14 bp, Artificial sequence
  synthetic sequence
taccagagacgaga

SEQ ID NO: 4519 - DNA, 14 bp, Artificial sequence
  synthetic sequence
ccatcaggagcaaa

SEQ ID NO: 4520 - DNA, 14 bp, Artificial sequence
  synthetic sequence
gagcgatgggcggc

SEQ ID NO: 4521 - DNA, 14 bp, Artificial sequence
  synthetic sequence
ccgcgatgcagcag

SEQ ID NO: 4522 - DNA, 14 bp, Artificial sequence
  synthetic sequence
aaagcaccgatcga

SEQ ID NO: 4523 - DNA, 14 bp, Artificial sequence
  synthetic sequence
cccaaatgcgggcc

SEQ ID NO: 4524 - DNA, 14 bp, Artificial sequence
  synthetic sequence
cagcccaatccggc

SEQ ID NO: 4525 - DNA, 14 bp, Artificial sequence
  synthetic sequence
agaacgagtaacca

SEQ ID NO: 4526 - DNA, 14 bp, Artificial sequence
  synthetic sequence
agggcgaaacacta

SEQ ID NO: 4527 - DNA, 14 bp, Artificial sequence
  synthetic sequence
cgatcagcgggaca

SEQ ID NO: 4528 - DNA, 14 bp, Artificial sequence
  synthetic sequence
ggcctaaggcagga

SEQ ID NO: 4529 - DNA, 14 bp, Artificial sequence
  synthetic sequence
ccaatacagagacg

SEQ ID NO: 4530 - DNA, 14 bp, Artificial sequence
  synthetic sequence
gaaaaggcgaaata

SEQ ID NO: 4531 - DNA, 14 bp, Artificial sequence
  synthetic sequence
aatgaacgagacac

SEQ ID NO: 4532 - DNA, 14 bp, Artificial sequence
  synthetic sequence
gctcaaacagccac

SEQ ID NO: 4533 - DNA, 14 bp, Artificial sequence
  synthetic sequence
aagcgcgacgaact

SEQ ID NO: 4534 - DNA, 14 bp, Artificial sequence
  synthetic sequence
cgcaagaataacga

SEQ ID NO: 4535 - DNA, 14 bp, Artificial sequence
  synthetic sequence
agagccgtggggag

SEQ ID NO: 4536 - DNA, 14 bp, Artificial sequence
  synthetic sequence
ggacccacgcagtc

SEQ ID NO: 4537 - DNA, 14 bp, Artificial sequence
  synthetic sequence
accgtagccaaagg

SEQ ID NO: 4538 - DNA, 14 bp, Artificial sequence
  synthetic sequence
gaacgcacgggctc

SEQ ID NO: 4539 - DNA, 14 bp, Artificial sequence
  synthetic sequence
atgcacaggccagg

SEQ ID NO: 4540 - DNA, 14 bp, Artificial sequence
  synthetic sequence
aggcaaaagcatgg

SEQ ID NO: 4541 - DNA, 14 bp, Artificial sequence
  synthetic sequence
taccgaggcgggga

SEQ ID NO: 4542 - DNA, 14 bp, Artificial sequence
  synthetic sequence
ggacgatggcacaa

SEQ ID NO: 4543 - DNA, 14 bp, Artificial sequence
  synthetic sequence
agagcatagcggaa

SEQ ID NO: 4544 - DNA, 14 bp, Artificial sequence
  synthetic sequence
agccggacacccta

SEQ ID NO: 4545 - DNA, 14 bp, Artificial sequence
  synthetic sequence
aatagaggacaggg

SEQ ID NO: 4546 - DNA, 14 bp, Artificial sequence
  synthetic sequence
ctggcgacgaccag

SEQ ID NO: 4547 - DNA, 14 bp, Artificial sequence
  synthetic sequence
cgcaacgctgccga

SEQ ID NO: 4548 - DNA, 14 bp, Artificial sequence
  synthetic sequence
accgcgatgcgccc

SEQ ID NO: 4549 - DNA, 14 bp, Artificial sequence
  synthetic sequence
ccgcagcagcgatc

SEQ ID NO: 4550 - DNA, 14 bp, Artificial sequence
  synthetic sequence
ggatgagacacccc

SEQ ID NO: 4551 - DNA, 14 bp, Artificial sequence
  synthetic sequence
caccgtaacacccc

SEQ ID NO: 4552 - DNA, 14 bp, Artificial sequence
  synthetic sequence
gcgtcgcggaacac

SEQ ID NO: 4553 - DNA, 14 bp, Artificial sequence
  synthetic sequence
gcccgaacagatcc

SEQ ID NO: 4554 - DNA, 14 bp, Artificial sequence
  synthetic sequence
agggaagagctaaa

SEQ ID NO: 4555 - DNA, 14 bp, Artificial sequence
  synthetic sequence
acgaacctaaacag

SEQ ID NO: 4556 - DNA, 14 bp, Artificial sequence
  synthetic sequence
gaagcacgcgagtg

SEQ ID NO: 4557 - DNA, 14 bp, Artificial sequence
  synthetic sequence
acggaaacaggctg

SEQ ID NO: 4558 - DNA, 14 bp, Artificial sequence
  synthetic sequence
aacatagggaaaag

SEQ ID NO: 4559 - DNA, 14 bp, Artificial sequence
  synthetic sequence
gcgagagacgtagg

SEQ ID NO: 4560 - DNA, 14 bp, Artificial sequence
  synthetic sequence
gagtacggaagcca

SEQ ID NO: 4561 - DNA, 14 bp, Artificial sequence
  synthetic sequence
gatcacagaaagag

SEQ ID NO: 4562 - DNA, 14 bp, Artificial sequence
  synthetic sequence
gaagggctggggcc

SEQ ID NO: 4563 - DNA, 14 bp, Artificial sequence
  synthetic sequence
ccaggagccgtaag

SEQ ID NO: 4564 - DNA, 14 bp, Artificial sequence
  synthetic sequence
agactcgccaggca

SEQ ID NO: 4565 - DNA, 14 bp, Artificial sequence
  synthetic sequence
ggacagtccccacc

SEQ ID NO: 4566 - DNA, 14 bp, Artificial sequence
  synthetic sequence
gcgccaccgagtga

SEQ ID NO: 4567 - DNA, 14 bp, Artificial sequence
  synthetic sequence
gcagcccagaactc

SEQ ID NO: 4568 - DNA, 14 bp, Artificial sequence
  synthetic sequence
acaggaagtcaccc

SEQ ID NO: 4569 - DNA, 14 bp, Artificial sequence
  synthetic sequence
actagcccaacagg

SEQ ID NO: 4570 - DNA, 14 bp, Artificial sequence
  synthetic sequence
ggccaagagcataa

SEQ ID NO: 4571 - DNA, 14 bp, Artificial sequence
  synthetic sequence
cacaaaagaaatag

SEQ ID NO: 4572 - DNA, 14 bp, Artificial sequence
  synthetic sequence
tgagcggaagacag

SEQ ID NO: 4573 - DNA, 14 bp, Artificial sequence
  synthetic sequence
cgaagaaaccactg

SEQ ID NO: 4574 - DNA, 14 bp, Artificial sequence
  synthetic sequence
cggaatgaagcaga

SEQ ID NO: 4575 - DNA, 14 bp, Artificial sequence
  synthetic sequence
acccgtgagacccg

SEQ ID NO: 4576 - DNA, 14 bp, Artificial sequence
  synthetic sequence
tacccgcaacagcg

SEQ ID NO: 4577 - DNA, 14 bp, Artificial sequence
  synthetic sequence
taaccgggcggcac

SEQ ID NO: 4578 - DNA, 14 bp, Artificial sequence
  synthetic sequence
gagaaaccctcgac

SEQ ID NO: 4579 - DNA, 14 bp, Artificial sequence
  synthetic sequence
acggcaaggaatga

SEQ ID NO: 4580 - DNA, 14 bp, Artificial sequence
  synthetic sequence
gagaatacaccccc

SEQ ID NO: 4581 - DNA, 14 bp, Artificial sequence
  synthetic sequence
agggtccaggcacg

SEQ ID NO: 4582 - DNA, 14 bp, Artificial sequence
  synthetic sequence
gggtaagcaagggg

SEQ ID NO: 4583 - DNA, 14 bp, Artificial sequence
  synthetic sequence
catggagggcgagg

SEQ ID NO: 4584 - DNA, 14 bp, Artificial sequence
  synthetic sequence
ggaccgaaacgtcg

SEQ ID NO: 4585 - DNA, 14 bp, Artificial sequence
  synthetic sequence
cgaccaagctacgg

SEQ ID NO: 4586 - DNA, 14 bp, Artificial sequence
  synthetic sequence
cggaaagtggagga

SEQ ID NO: 4587 - DNA, 14 bp, Artificial sequence
  synthetic sequence
ccagggaccgtgga

SEQ ID NO: 4588 - DNA, 14 bp, Artificial sequence
  synthetic sequence
ccgacgctggaacc

SEQ ID NO: 4589 - DNA, 14 bp, Artificial sequence
  synthetic sequence
ataaaagaaacccg

SEQ ID NO: 4590 - DNA, 14 bp, Artificial sequence
  synthetic sequence
gggagacacataaa

SEQ ID NO: 4591 - DNA, 14 bp, Artificial sequence
  synthetic sequence
gcgcgtacacccag

SEQ ID NO: 4592 - DNA, 14 bp, Artificial sequence
  synthetic sequence
aggaccataaaccc

SEQ ID NO: 4593 - DNA, 14 bp, Artificial sequence
  synthetic sequence
ggggtacgccagca

SEQ ID NO: 4594 - DNA, 14 bp, Artificial sequence
  synthetic sequence
aggcccaagagcct

SEQ ID NO: 4595 - DNA, 14 bp, Artificial sequence
  synthetic sequence
cggaatgagaagcg

SEQ ID NO: 4596 - DNA, 14 bp, Artificial sequence
  synthetic sequence
atgccgaggcacgc

SEQ ID NO: 4597 - DNA, 14 bp, Artificial sequence
  synthetic sequence
gggaaaataagaac

SEQ ID NO: 4598 - DNA, 14 bp, Artificial sequence
  synthetic sequence
cagcgcaagactac

SEQ ID NO: 4599 - DNA, 14 bp, Artificial sequence
  synthetic sequence
ccggtccatgacac

SEQ ID NO: 4600 - DNA, 14 bp, Artificial sequence
  synthetic sequence
ccgtcgaatcggca

SEQ ID NO: 4601 - DNA, 14 bp, Artificial sequence
  synthetic sequence
ccgagtaacgctgc

SEQ ID NO: 4602 - DNA, 14 bp, Artificial sequence
  synthetic sequence
ccgctgatggacgg

SEQ ID NO: 4603 - DNA, 14 bp, Artificial sequence
  synthetic sequence
cggtgtaaccgcag

SEQ ID NO: 4604 - DNA, 14 bp, Artificial sequence
  synthetic sequence
tgcaccgagctgag

SEQ ID NO: 4605 - DNA, 14 bp, Artificial sequence
  synthetic sequence
acgtggcctgcaaa

SEQ ID NO: 4606 - DNA, 14 bp, Artificial sequence
  synthetic sequence
cgcccacacttgac

SEQ ID NO: 4607 - DNA, 14 bp, Artificial sequence
  synthetic sequence
acaactatccgaac

SEQ ID NO: 4608 - DNA, 14 bp, Artificial sequence
  synthetic sequence
tgactacgacccac

SEQ ID NO: 4609 - DNA, 14 bp, Artificial sequence
  synthetic sequence
cgcgcagctcatac

SEQ ID NO: 4610 - DNA, 14 bp, Artificial sequence
  synthetic sequence
cctcgaggtcagag

SEQ ID NO: 4611 - DNA, 14 bp, Artificial sequence
  synthetic sequence
tgcctccaggaccg

SEQ ID NO: 4612 - DNA, 14 bp, Artificial sequence
  synthetic sequence
atgccgaggtggca

SEQ ID NO: 4613 - DNA, 14 bp, Artificial sequence
  synthetic sequence
gagtatcgccaagg

SEQ ID NO: 4614 - DNA, 14 bp, Artificial sequence
  synthetic sequence
gcatctcgccccaa

SEQ ID NO: 4615 - DNA, 14 bp, Artificial sequence
  synthetic sequence
gaggatcgatggcg

SEQ ID NO: 4616 - DNA, 14 bp, Artificial sequence
  synthetic sequence
acataagtggaaaa

SEQ ID NO: 4617 - DNA, 14 bp, Artificial sequence
  synthetic sequence
acgacagcgagtat

SEQ ID NO: 4618 - DNA, 14 bp, Artificial sequence
  synthetic sequence
ccgacaccctcctg

SEQ ID NO: 4619 - DNA, 14 bp, Artificial sequence
  synthetic sequence
atcccacgtcacca

SEQ ID NO: 4620 - DNA, 14 bp, Artificial sequence
  synthetic sequence
agaaccacccgttc

SEQ ID NO: 4621 - DNA, 14 bp, Artificial sequence
  synthetic sequence
acacagagctctgg

SEQ ID NO: 4622 - DNA, 14 bp, Artificial sequence
  synthetic sequence
gaaaaacttaaggg

SEQ ID NO: 4623 - DNA, 14 bp, Artificial sequence
  synthetic sequence
gggacgccgataat

SEQ ID NO: 4624 - DNA, 14 bp, Artificial sequence
  synthetic sequence
cgaactcagtagcc

SEQ ID NO: 4625 - DNA, 14 bp, Artificial sequence
  synthetic sequence
gctaacatccagcg

SEQ ID NO: 4626 - DNA, 14 bp, Artificial sequence
  synthetic sequence
tgcccaggtaaagg

SEQ ID NO: 4627 - DNA, 14 bp, Artificial sequence
  synthetic sequence
atataggaaccgcc

SEQ ID NO: 4628 - DNA, 14 bp, Artificial sequence
  synthetic sequence
gagctgggatgcgc

SEQ ID NO: 4629 - DNA, 14 bp, Artificial sequence
  synthetic sequence
atgcgtcgccaaga

SEQ ID NO: 4630 - DNA, 14 bp, Artificial sequence
  synthetic sequence
ggaatgcctaagaa

SEQ ID NO: 4631 - DNA, 14 bp, Artificial sequence
  synthetic sequence
aaacgcccagtata

SEQ ID NO: 4632 - DNA, 14 bp, Artificial sequence
  synthetic sequence
actaccgcacgtaa

SEQ ID NO: 4633 - DNA, 14 bp, Artificial sequence
  synthetic sequence
ccggtgagaggtaa

SEQ ID NO: 4634 - DNA, 14 bp, Artificial sequence
  synthetic sequence
tcggcctcacacgc

SEQ ID NO: 4635 - DNA, 14 bp, Artificial sequence
  synthetic sequence
catgaaaagcacct

SEQ ID NO: 4636 - DNA, 14 bp, Artificial sequence
  synthetic sequence
gcatgcagggtagc

SEQ ID NO: 4637 - DNA, 14 bp, Artificial sequence
  synthetic sequence
tacgctgggaagca

SEQ ID NO: 4638 - DNA, 14 bp, Artificial sequence
  synthetic sequence
actaccaaggatca

SEQ ID NO: 4639 - DNA, 14 bp, Artificial sequence
  synthetic sequence
tacgagtaagggcc

SEQ ID NO: 4640 - DNA, 14 bp, Artificial sequence
  synthetic sequence
gtcctacaacacag

SEQ ID NO: 4641 - DNA, 14 bp, Artificial sequence
  synthetic sequence
gtcacaagacctcg

SEQ ID NO: 4642 - DNA, 14 bp, Artificial sequence
  synthetic sequence
tacggcaggcacgt

SEQ ID NO: 4643 - DNA, 14 bp, Artificial sequence
  synthetic sequence
ccgagcatacctgg

SEQ ID NO: 4644 - DNA, 14 bp, Artificial sequence
  synthetic sequence
aagctgtggagcca

SEQ ID NO: 4645 - DNA, 14 bp, Artificial sequence
  synthetic sequence
atgggggagctgca

SEQ ID NO: 4646 - DNA, 14 bp, Artificial sequence
  synthetic sequence
aagggacgtcatag

SEQ ID NO: 4647 - DNA, 14 bp, Artificial sequence
  synthetic sequence
gtggagaaccggta

SEQ ID NO: 4648 - DNA, 14 bp, Artificial sequence
  synthetic sequence
cgtactaacggacc

SEQ ID NO: 4649 - DNA, 14 bp, Artificial sequence
  synthetic sequence
ccgtaatagaaccc

SEQ ID NO: 4650 - DNA, 14 bp, Artificial sequence
  synthetic sequence
gtgaacatgcgcgg

SEQ ID NO: 4651 - DNA, 14 bp, Artificial sequence
  synthetic sequence
gcaaaaggtgagtg

SEQ ID NO: 4652 - DNA, 14 bp, Artificial sequence
  synthetic sequence
ggaccgcactctca

SEQ ID NO: 4653 - DNA, 14 bp, Artificial sequence
  synthetic sequence
aacagcacctacta

SEQ ID NO: 4654 - DNA, 14 bp, Artificial sequence
  synthetic sequence
gcagatcatagggg

SEQ ID NO: 4655 - DNA, 14 bp, Artificial sequence
  synthetic sequence
gcgccttcgcacga

SEQ ID NO: 4656 - DNA, 14 bp, Artificial sequence
  synthetic sequence
aatgtggcacgaca

SEQ ID NO: 4657 - DNA, 14 bp, Artificial sequence
  synthetic sequence
aaaaagcgtgcatg

SEQ ID NO: 4658 - DNA, 14 bp, Artificial sequence
  synthetic sequence
accgataaagatac

SEQ ID NO: 4659 - DNA, 14 bp, Artificial sequence
  synthetic sequence
ccgcactagagact

SEQ ID NO: 4660 - DNA, 14 bp, Artificial sequence
  synthetic sequence
gccactgtacgcac

SEQ ID NO: 4661 - DNA, 14 bp, Artificial sequence
  synthetic sequence
gcgctggcgaacgt

SEQ ID NO: 4662 - DNA, 14 bp, Artificial sequence
  synthetic sequence
gctcccggataaca

SEQ ID NO: 4663 - DNA, 14 bp, Artificial sequence
  synthetic sequence
aacctggtccagaa

SEQ ID NO: 4664 - DNA, 14 bp, Artificial sequence
  synthetic sequence
cttaccagcagccg

SEQ ID NO: 4665 - DNA, 14 bp, Artificial sequence
  synthetic sequence
ctgccaaggcagta

SEQ ID NO: 4666 - DNA, 14 bp, Artificial sequence
  synthetic sequence
aaagccttaggcac

SEQ ID NO: 4667 - DNA, 14 bp, Artificial sequence
  synthetic sequence
ggaattgccgcagg

SEQ ID NO: 4668 - DNA, 14 bp, Artificial sequence
  synthetic sequence
acgataagtggaaa

SEQ ID NO: 4669 - DNA, 14 bp, Artificial sequence
  synthetic sequence
cggcaagtaatcgg

SEQ ID NO: 4670 - DNA, 14 bp, Artificial sequence
  synthetic sequence
ctacggaacgggat

SEQ ID NO: 4671 - DNA, 14 bp, Artificial sequence
  synthetic sequence
cccggaatagctac

SEQ ID NO: 4672 - DNA, 14 bp, Artificial sequence
  synthetic sequence
cctcaccgagtccc

SEQ ID NO: 4673 - DNA, 14 bp, Artificial sequence
  synthetic sequence
ccggagtaagctag

SEQ ID NO: 4674 - DNA, 14 bp, Artificial sequence
  synthetic sequence
tagaacggaatcgc

SEQ ID NO: 4675 - DNA, 14 bp, Artificial sequence
  synthetic sequence
aatcgggcggcgat

SEQ ID NO: 4676 - DNA, 14 bp, Artificial sequence
  synthetic sequence
cgaagccgtcaatc

SEQ ID NO: 4677 - DNA, 14 bp, Artificial sequence
  synthetic sequence
agcggaagcagatt

SEQ ID NO: 4678 - DNA, 14 bp, Artificial sequence
  synthetic sequence
cagtgtgggcacga

SEQ ID NO: 4679 - DNA, 14 bp, Artificial sequence
  synthetic sequence
cgtgacgggtgccc

SEQ ID NO: 4680 - DNA, 14 bp, Artificial sequence
  synthetic sequence
gtaagaaagctcga

SEQ ID NO: 4681 - DNA, 14 bp, Artificial sequence
  synthetic sequence
agactactagcagc

SEQ ID NO: 4682 - DNA, 14 bp, Artificial sequence
  synthetic sequence
cagcgctatggacg

SEQ ID NO: 4683 - DNA, 14 bp, Artificial sequence
  synthetic sequence
tggagtagagaacc

SEQ ID NO: 4684 - DNA, 14 bp, Artificial sequence
  synthetic sequence
aatacacgggacta

SEQ ID NO: 4685 - DNA, 14 bp, Artificial sequence
  synthetic sequence
gaacccggtagggt

SEQ ID NO: 4686 - DNA, 14 bp, Artificial sequence
  synthetic sequence
ttcacaaagggggg

SEQ ID NO: 4687 - DNA, 14 bp, Artificial sequence
  synthetic sequence
aggaggcctcagat

SEQ ID NO: 4688 - DNA, 14 bp, Artificial sequence
  synthetic sequence
ccgagccgtggtcg

SEQ ID NO: 4689 - DNA, 14 bp, Artificial sequence
  synthetic sequence
cgaatgaatgggac

SEQ ID NO: 4690 - DNA, 14 bp, Artificial sequence
  synthetic sequence
ccacaggttacccg

SEQ ID NO: 4691 - DNA, 14 bp, Artificial sequence
  synthetic sequence
gtcgcacaaatgcc

SEQ ID NO: 4692 - DNA, 14 bp, Artificial sequence
  synthetic sequence
gcgctaagaaaact

SEQ ID NO: 4693 - DNA, 14 bp, Artificial sequence
  synthetic sequence
tcgtgccccaagga

SEQ ID NO: 4694 - DNA, 14 bp, Artificial sequence
  synthetic sequence
ttgcacccaggaga

SEQ ID NO: 4695 - DNA, 14 bp, Artificial sequence
  synthetic sequence
cggacgagtaaggt

SEQ ID NO: 4696 - DNA, 14 bp, Artificial sequence
  synthetic sequence
gaatcaggggaggt

SEQ ID NO: 4697 - DNA, 14 bp, Artificial sequence
  synthetic sequence
caagcatccaatac

SEQ ID NO: 4698 - DNA, 14 bp, Artificial sequence
  synthetic sequence
acactcgtgcacag

SEQ ID NO: 4699 - DNA, 14 bp, Artificial sequence
  synthetic sequence
caggcgtgcgtgac

SEQ ID NO: 4700 - DNA, 14 bp, Artificial sequence
  synthetic sequence
aggtccggacgtga

SEQ ID NO: 4701 - DNA, 14 bp, Artificial sequence
  synthetic sequence
gctcgcccaggtgc

SEQ ID NO: 4702 - DNA, 14 bp, Artificial sequence
  synthetic sequence
gatcctcccaaggg

SEQ ID NO: 4703 - DNA, 14 bp, Artificial sequence
  synthetic sequence
cgtgcgcagaaata

SEQ ID NO: 4704 - DNA, 14 bp, Artificial sequence
  synthetic sequence
tagtaaccgaaaca

SEQ ID NO: 4705 - DNA, 14 bp, Artificial sequence
  synthetic sequence
taatgggcacagag

SEQ ID NO: 4706 - DNA, 14 bp, Artificial sequence
  synthetic sequence
aactccgaccacat

SEQ ID NO: 4707 - DNA, 14 bp, Artificial sequence
  synthetic sequence
cgccaggtggcatg

SEQ ID NO: 4708 - DNA, 14 bp, Artificial sequence
  synthetic sequence
actcggagtacaac

SEQ ID NO: 4709 - DNA, 14 bp, Artificial sequence
  synthetic sequence
gcctataagagcac

SEQ ID NO: 4710 - DNA, 14 bp, Artificial sequence
  synthetic sequence
gcaggaggatgtac

SEQ ID NO: 4711 - DNA, 14 bp, Artificial sequence
  synthetic sequence
tcatacggacaaga

SEQ ID NO: 4712 - DNA, 14 bp, Artificial sequence
  synthetic sequence
aacgcgctgtgcgg

SEQ ID NO: 4713 - DNA, 14 bp, Artificial sequence
  synthetic sequence
aactcagcgatcac

SEQ ID NO: 4714 - DNA, 14 bp, Artificial sequence
  synthetic sequence
ccccagtaaatgcc

SEQ ID NO: 4715 - DNA, 14 bp, Artificial sequence
  synthetic sequence
taacgagaaaacat

SEQ ID NO: 4716 - DNA, 14 bp, Artificial sequence
  synthetic sequence
cccctcgggtcaac

SEQ ID NO: 4717 - DNA, 14 bp, Artificial sequence
  synthetic sequence
cgactctcaaccac

SEQ ID NO: 4718 - DNA, 14 bp, Artificial sequence
  synthetic sequence
cctaggggcagtgc

SEQ ID NO: 4719 - DNA, 14 bp, Artificial sequence
  synthetic sequence
cgcagggtggaaat

SEQ ID NO: 4720 - DNA, 14 bp, Artificial sequence
  synthetic sequence
tagccccaccatgg

SEQ ID NO: 4721 - DNA, 14 bp, Artificial sequence
  synthetic sequence
gacgaaggttgacg

SEQ ID NO: 4722 - DNA, 14 bp, Artificial sequence
  synthetic sequence
gtagagggactcga

SEQ ID NO: 4723 - DNA, 14 bp, Artificial sequence
  synthetic sequence
acctgccgagtaag

SEQ ID NO: 4724 - DNA, 14 bp, Artificial sequence
  synthetic sequence
cgctaacgtacagc

SEQ ID NO: 4725 - DNA, 14 bp, Artificial sequence
  synthetic sequence
agcggatgcgctcc

SEQ ID NO: 4726 - DNA, 14 bp, Artificial sequence
  synthetic sequence
actaccaccacaat

SEQ ID NO: 4727 - DNA, 14 bp, Artificial sequence
  synthetic sequence
tggacggaaacgat

SEQ ID NO: 4728 - DNA, 14 bp, Artificial sequence
  synthetic sequence
gccaactacactgg

SEQ ID NO: 4729 - DNA, 14 bp, Artificial sequence
  synthetic sequence
ccctcgactaaccg

SEQ ID NO: 4730 - DNA, 14 bp, Artificial sequence
  synthetic sequence
aatccagctaacgg

SEQ ID NO: 4731 - DNA, 14 bp, Artificial sequence
  synthetic sequence
ctgaaggcgagcat

SEQ ID NO: 4732 - DNA, 14 bp, Artificial sequence
  synthetic sequence
cggccaatcacgtc

SEQ ID NO: 4733 - DNA, 14 bp, Artificial sequence
  synthetic sequence
acctcgctcgccgc

SEQ ID NO: 4734 - DNA, 14 bp, Artificial sequence
  synthetic sequence
ggggcacataatca

SEQ ID NO: 4735 - DNA, 14 bp, Artificial sequence
  synthetic sequence
cggtacaccaaggt

SEQ ID NO: 4736 - DNA, 14 bp, Artificial sequence
  synthetic sequence
ctcccatgcgaaca

SEQ ID NO: 4737 - DNA, 14 bp, Artificial sequence
  synthetic sequence
ggagatgaaatgac

SEQ ID NO: 4738 - DNA, 14 bp, Artificial sequence
  synthetic sequence
taaaaatcgcagaa

SEQ ID NO: 4739 - DNA, 14 bp, Artificial sequence
  synthetic sequence
aatgaaagtagaaa

SEQ ID NO: 4740 - DNA, 14 bp, Artificial sequence
  synthetic sequence
gtatgaagcgcgca

SEQ ID NO: 4741 - DNA, 14 bp, Artificial sequence
  synthetic sequence
tagggcctaagaag

SEQ ID NO: 4742 - DNA, 14 bp, Artificial sequence
  synthetic sequence
ggatgcgtacgccc

SEQ ID NO: 4743 - DNA, 14 bp, Artificial sequence
  synthetic sequence
aaggacgtatacgg

SEQ ID NO: 4744 - DNA, 14 bp, Artificial sequence
  synthetic sequence
ccgaagggctcatg

SEQ ID NO: 4745 - DNA, 14 bp, Artificial sequence
  synthetic sequence
gtactgagcaacgg

SEQ ID NO: 4746 - DNA, 14 bp, Artificial sequence
  synthetic sequence
catgaaatccggca

SEQ ID NO: 4747 - DNA, 14 bp, Artificial sequence
  synthetic sequence
cgtataaacgaaga

SEQ ID NO: 4748 - DNA, 14 bp, Artificial sequence
  synthetic sequence
agtaactgaggacg

SEQ ID NO: 4749 - DNA, 14 bp, Artificial sequence
  synthetic sequence
cgacgcgtccgtgc

SEQ ID NO: 4750 - DNA, 14 bp, Artificial sequence
  synthetic sequence
cctaccccaaacta

SEQ ID NO: 4751 - DNA, 14 bp, Artificial sequence
  synthetic sequence
gagtgcagagtgcc

SEQ ID NO: 4752 - DNA, 14 bp, Artificial sequence
  synthetic sequence
aaagtcggcagctg

SEQ ID NO: 4753 - DNA, 14 bp, Artificial sequence
  synthetic sequence
tccggcatgaggcg

SEQ ID NO: 4754 - DNA, 14 bp, Artificial sequence
  synthetic sequence
gtcgggaagaggtc

SEQ ID NO: 4755 - DNA, 14 bp, Artificial sequence
  synthetic sequence
cctgtacgaaacgg

SEQ ID NO: 4756 - DNA, 14 bp, Artificial sequence
  synthetic sequence
tggaggccaatacg

SEQ ID NO: 4757 - DNA, 14 bp, Artificial sequence
  synthetic sequence
atgcacccggagat

SEQ ID NO: 4758 - DNA, 14 bp, Artificial sequence
  synthetic sequence
ctcgccagcatcga

SEQ ID NO: 4759 - DNA, 14 bp, Artificial sequence
  synthetic sequence
tgctccgacgggcc

SEQ ID NO: 4760 - DNA, 14 bp, Artificial sequence
  synthetic sequence
gtacgggtcgaaac

SEQ ID NO: 4761 - DNA, 14 bp, Artificial sequence
  synthetic sequence
gaaggagacgtata

SEQ ID NO: 4762 - DNA, 14 bp, Artificial sequence
  synthetic sequence
ctcacgccgagtcg

SEQ ID NO: 4763 - DNA, 14 bp, Artificial sequence
  synthetic sequence
aagcaatgcgatca

SEQ ID NO: 4764 - DNA, 14 bp, Artificial sequence
  synthetic sequence
gaggtcaatcgacc

SEQ ID NO: 4765 - DNA, 14 bp, Artificial sequence
  synthetic sequence
aggacgtaccaatc

SEQ ID NO: 4766 - DNA, 14 bp, Artificial sequence
  synthetic sequence
cgtccagcataggg

SEQ ID NO: 4767 - DNA, 14 bp, Artificial sequence
  synthetic sequence
cagcaaactgcatc

SEQ ID NO: 4768 - DNA, 14 bp, Artificial sequence
  synthetic sequence
tgggtacggggaca

SEQ ID NO: 4769 - DNA, 14 bp, Artificial sequence
  synthetic sequence
actacactaccgcc

SEQ ID NO: 4770 - DNA, 14 bp, Artificial sequence
  synthetic sequence
cgtccgcaactcgc

SEQ ID NO: 4771 - DNA, 14 bp, Artificial sequence
  synthetic sequence
ggccactagatggg

SEQ ID NO: 4772 - DNA, 14 bp, Artificial sequence
  synthetic sequence
ctgagcgctcccgg

SEQ ID NO: 4773 - DNA, 14 bp, Artificial sequence
  synthetic sequence
aagcgtcagccctc

SEQ ID NO: 4774 - DNA, 14 bp, Artificial sequence
  synthetic sequence
catagccacctcga

SEQ ID NO: 4775 - DNA, 14 bp, Artificial sequence
  synthetic sequence
gactgacatccaag

SEQ ID NO: 4776 - DNA, 14 bp, Artificial sequence
  synthetic sequence
tacagacagataac

SEQ ID NO: 4777 - DNA, 14 bp, Artificial sequence
  synthetic sequence
gcaactatcagcgg

SEQ ID NO: 4778 - DNA, 14 bp, Artificial sequence
  synthetic sequence
tgcggacatagacc

SEQ ID NO: 4779 - DNA, 14 bp, Artificial sequence
  synthetic sequence
cgaagcatgaaact

SEQ ID NO: 4780 - DNA, 14 bp, Artificial sequence
  synthetic sequence
caaacaaggaatta

SEQ ID NO: 4781 - DNA, 14 bp, Artificial sequence
  synthetic sequence
ggaatatgcaacca

SEQ ID NO: 4782 - DNA, 14 bp, Artificial sequence
  synthetic sequence
agcgcgaagtatcc

SEQ ID NO: 4783 - DNA, 14 bp, Artificial sequence
  synthetic sequence
cttcgaaaacggaa

SEQ ID NO: 4784 - DNA, 14 bp, Artificial sequence
  synthetic sequence
agggatcaagtcca

SEQ ID NO: 4785 - DNA, 14 bp, Artificial sequence
  synthetic sequence
catagagtagcaag

SEQ ID NO: 4786 - DNA, 14 bp, Artificial sequence
  synthetic sequence
ggctaagaaaccgt

SEQ ID NO: 4787 - DNA, 14 bp, Artificial sequence
  synthetic sequence
gagcctaagataag

SEQ ID NO: 4788 - DNA, 14 bp, Artificial sequence
  synthetic sequence
actccctagcgcac

SEQ ID NO: 4789 - DNA, 14 bp, Artificial sequence
  synthetic sequence
ctggaccccctgcg

SEQ ID NO: 4790 - DNA, 14 bp, Artificial sequence
  synthetic sequence
taacacgagactgg

SEQ ID NO: 4791 - DNA, 14 bp, Artificial sequence
  synthetic sequence
cccataatcgggaa

SEQ ID NO: 4792 - DNA, 14 bp, Artificial sequence
  synthetic sequence
cggtaagggtacgg

SEQ ID NO: 4793 - DNA, 14 bp, Artificial sequence
  synthetic sequence
caatggcacgctag

SEQ ID NO: 4794 - DNA, 14 bp, Artificial sequence
  synthetic sequence
gatagagtcccagc

SEQ ID NO: 4795 - DNA, 14 bp, Artificial sequence
  synthetic sequence
catcctagacggac

SEQ ID NO: 4796 - DNA, 14 bp, Artificial sequence
  synthetic sequence
ttacccaacacacg

SEQ ID NO: 4797 - DNA, 14 bp, Artificial sequence
  synthetic sequence
ccaccagtatcacg

SEQ ID NO: 4798 - DNA, 14 bp, Artificial sequence
  synthetic sequence
agcgaccgttcgaa

SEQ ID NO: 4799 - DNA, 14 bp, Artificial sequence
  synthetic sequence
aaacacgttacgaa

SEQ ID NO: 4800 - DNA, 14 bp, Artificial sequence
  synthetic sequence
gaaagccaggcatt

SEQ ID NO: 4801 - DNA, 14 bp, Artificial sequence
  synthetic sequence
ggggctaagagtcc

SEQ ID NO: 4802 - DNA, 14 bp, Artificial sequence
  synthetic sequence
acagaacgtcgtca

SEQ ID NO: 4803 - DNA, 14 bp, Artificial sequence
  synthetic sequence
ggcgctcagctagc

SEQ ID NO: 4804 - DNA, 14 bp, Artificial sequence
  synthetic sequence
atatacccggcgcc

SEQ ID NO: 4805 - DNA, 14 bp, Artificial sequence
  synthetic sequence
gactacaggctccg

SEQ ID NO: 4806 - DNA, 14 bp, Artificial sequence
  synthetic sequence
acgtactaaaggcc

SEQ ID NO: 4807 - DNA, 14 bp, Artificial sequence
  synthetic sequence
aaccgccagtgtaa

SEQ ID NO: 4808 - DNA, 14 bp, Artificial sequence
  synthetic sequence
cgacgtggcgtgca

SEQ ID NO: 4809 - DNA, 14 bp, Artificial sequence
  synthetic sequence
tccagacgcccact

SEQ ID NO: 4810 - DNA, 14 bp, Artificial sequence
  synthetic sequence
ctagggggtcaacc

SEQ ID NO: 4811 - DNA, 14 bp, Artificial sequence
  synthetic sequence
cgatagaactaggg

SEQ ID NO: 4812 - DNA, 14 bp, Artificial sequence
  synthetic sequence
cgaggtagcaaagt

SEQ ID NO: 4813 - DNA, 14 bp, Artificial sequence
  synthetic sequence
gcggaaatcagact

SEQ ID NO: 4814 - DNA, 14 bp, Artificial sequence
  synthetic sequence
acctcaggcctgac

SEQ ID NO: 4815 - DNA, 14 bp, Artificial sequence
  synthetic sequence
ctaatagacaagcc

SEQ ID NO: 4816 - DNA, 14 bp, Artificial sequence
  synthetic sequence
catgggcgaatgga

SEQ ID NO: 4817 - DNA, 14 bp, Artificial sequence
  synthetic sequence
ccaagacctaatga

SEQ ID NO: 4818 - DNA, 14 bp, Artificial sequence
  synthetic sequence
gagccgactgaact

SEQ ID NO: 4819 - DNA, 14 bp, Artificial sequence
  synthetic sequence
taactgcaacgacc

SEQ ID NO: 4820 - DNA, 14 bp, Artificial sequence
  synthetic sequence
gaacgatagtcacg

SEQ ID NO: 4821 - DNA, 14 bp, Artificial sequence
  synthetic sequence
tagcgtggaaaaac

SEQ ID NO: 4822 - DNA, 14 bp, Artificial sequence
  synthetic sequence
ccaccagacgcgtt

SEQ ID NO: 4823 - DNA, 14 bp, Artificial sequence
  synthetic sequence
aaatgaagtaagaa

SEQ ID NO: 4824 - DNA, 14 bp, Artificial sequence
  synthetic sequence
aagaacctatggca

SEQ ID NO: 4825 - DNA, 14 bp, Artificial sequence
  synthetic sequence
cagtccgaccccta

SEQ ID NO: 4826 - DNA, 14 bp, Artificial sequence
  synthetic sequence
gagagataggagtg

SEQ ID NO: 4827 - DNA, 14 bp, Artificial sequence
  synthetic sequence
gctcaacagcgtgg

SEQ ID NO: 4828 - DNA, 14 bp, Artificial sequence
  synthetic sequence
ggcaaagatataag

SEQ ID NO: 4829 - DNA, 14 bp, Artificial sequence
  synthetic sequence
ctcccagatcgaga

SEQ ID NO: 4830 - DNA, 14 bp, Artificial sequence
  synthetic sequence
ggactccgtgacaa

SEQ ID NO: 4831 - DNA, 14 bp, Artificial sequence
  synthetic sequence
gcataatgccgcca

SEQ ID NO: 4832 - DNA, 14 bp, Artificial sequence
  synthetic sequence
gggagtccgtggga

SEQ ID NO: 4833 - DNA, 14 bp, Artificial sequence
  synthetic sequence
taacgacagctaca

SEQ ID NO: 4834 - DNA, 14 bp, Artificial sequence
  synthetic sequence
aaaactcagacaat

SEQ ID NO: 4835 - DNA, 14 bp, Artificial sequence
  synthetic sequence
atccccgacgcata

SEQ ID NO: 4836 - DNA, 14 bp, Artificial sequence
  synthetic sequence
catgacgcaatacc

SEQ ID NO: 4837 - DNA, 14 bp, Artificial sequence
  synthetic sequence
acactggcgactca

SEQ ID NO: 4838 - DNA, 14 bp, Artificial sequence
  synthetic sequence
ccccgacgtagcgt

SEQ ID NO: 4839 - DNA, 14 bp, Artificial sequence
  synthetic sequence
tcataagagaagga

SEQ ID NO: 4840 - DNA, 14 bp, Artificial sequence
  synthetic sequence
ggatgcaaatccag

SEQ ID NO: 4841 - DNA, 14 bp, Artificial sequence
  synthetic sequence
ggcaggctccatcg

SEQ ID NO: 4842 - DNA, 14 bp, Artificial sequence
  synthetic sequence
agctaaaaggctga

SEQ ID NO: 4843 - DNA, 14 bp, Artificial sequence
  synthetic sequence
attaacgagccgga

SEQ ID NO: 4844 - DNA, 14 bp, Artificial sequence
  synthetic sequence
ttaagagaccacac

SEQ ID NO: 4845 - DNA, 14 bp, Artificial sequence
  synthetic sequence
ggtatggaccggcg

SEQ ID NO: 4846 - DNA, 14 bp, Artificial sequence
  synthetic sequence
taacgaaagtgagc

SEQ ID NO: 4847 - DNA, 14 bp, Artificial sequence
  synthetic sequence
aagaattcgaccag

SEQ ID NO: 4848 - DNA, 14 bp, Artificial sequence
  synthetic sequence
acccgcaccttgag

SEQ ID NO: 4849 - DNA, 14 bp, Artificial sequence
  synthetic sequence
gtaagaggcaagat

SEQ ID NO: 4850 - DNA, 14 bp, Artificial sequence
  synthetic sequence
aagccagattggaa

SEQ ID NO: 4851 - DNA, 14 bp, Artificial sequence
  synthetic sequence
ggccttaacaacaa

SEQ ID NO: 4852 - DNA, 14 bp, Artificial sequence
  synthetic sequence
cctggatggcgcaa

SEQ ID NO: 4853 - DNA, 14 bp, Artificial sequence
  synthetic sequence
caaatgaccataac

SEQ ID NO: 4854 - DNA, 14 bp, Artificial sequence
  synthetic sequence
tgctcaagcgggaa

SEQ ID NO: 4855 - DNA, 14 bp, Artificial sequence
  synthetic sequence
gaaacggtaaaggt

SEQ ID NO: 4856 - DNA, 14 bp, Artificial sequence
  synthetic sequence
gcatcagagccata

SEQ ID NO: 4857 - DNA, 14 bp, Artificial sequence
  synthetic sequence
aaacgcgtgcccct

SEQ ID NO: 4858 - DNA, 14 bp, Artificial sequence
  synthetic sequence
cggcacattaccaa

SEQ ID NO: 4859 - DNA, 14 bp, Artificial sequence
  synthetic sequence
atcgcgaatccgcc

SEQ ID NO: 4860 - DNA, 14 bp, Artificial sequence
  synthetic sequence
ggcgagtcccctag

SEQ ID NO: 4861 - DNA, 14 bp, Artificial sequence
  synthetic sequence
gaatcgcataacaa

SEQ ID NO: 4862 - DNA, 14 bp, Artificial sequence
  synthetic sequence
aagctataaccgag

SEQ ID NO: 4863 - DNA, 14 bp, Artificial sequence
  synthetic sequence
actcaaggatacaa

SEQ ID NO: 4864 - DNA, 14 bp, Artificial sequence
  synthetic sequence
tcaccatcgggacc

SEQ ID NO: 4865 - DNA, 14 bp, Artificial sequence
  synthetic sequence
tcctgacgccggag

SEQ ID NO: 4866 - DNA, 14 bp, Artificial sequence
  synthetic sequence
cccacctggctaac

SEQ ID NO: 4867 - DNA, 14 bp, Artificial sequence
  synthetic sequence
cctacccacaaact

SEQ ID NO: 4868 - DNA, 14 bp, Artificial sequence
  synthetic sequence
atagcgaagcataa

SEQ ID NO: 4869 - DNA, 14 bp, Artificial sequence
  synthetic sequence
agatccccatgcaa

SEQ ID NO: 4870 - DNA, 14 bp, Artificial sequence
  synthetic sequence
tggaaccgaagata

SEQ ID NO: 4871 - DNA, 14 bp, Artificial sequence
  synthetic sequence
agataggtaaaagc

SEQ ID NO: 4872 - DNA, 14 bp, Artificial sequence
  synthetic sequence
cccacatcgccact

SEQ ID NO: 4873 - DNA, 14 bp, Artificial sequence
  synthetic sequence
ctaccctaccgcgg

SEQ ID NO: 4874 - DNA, 14 bp, Artificial sequence
  synthetic sequence
cggaaaacggtata

SEQ ID NO: 4875 - DNA, 14 bp, Artificial sequence
  synthetic sequence
agagcggtggtcca

SEQ ID NO: 4876 - DNA, 14 bp, Artificial sequence
  synthetic sequence
ggacctagcatggg

SEQ ID NO: 4877 - DNA, 14 bp, Artificial sequence
  synthetic sequence
cgataggaaacatg

SEQ ID NO: 4878 - DNA, 14 bp, Artificial sequence
  synthetic sequence
cgtcacacgtggga

SEQ ID NO: 4879 - DNA, 14 bp, Artificial sequence
  synthetic sequence
acacgagccgaatt

SEQ ID NO: 4880 - DNA, 14 bp, Artificial sequence
  synthetic sequence
tacatcaggagacg

SEQ ID NO: 4881 - DNA, 14 bp, Artificial sequence
  synthetic sequence
cggaaccgacgtct

SEQ ID NO: 4882 - DNA, 14 bp, Artificial sequence
  synthetic sequence
gcaggacttcggac

SEQ ID NO: 4883 - DNA, 14 bp, Artificial sequence
  synthetic sequence
tagataaggaaaga

SEQ ID NO: 4884 - DNA, 14 bp, Artificial sequence
  synthetic sequence
catcgacaaacgat

SEQ ID NO: 4885 - DNA, 14 bp, Artificial sequence
  synthetic sequence
ctcgtacggcggcc

SEQ ID NO: 4886 - DNA, 14 bp, Artificial sequence
  synthetic sequence
aaaagtcagcctca

SEQ ID NO: 4887 - DNA, 14 bp, Artificial sequence
  synthetic sequence
atccaataggaata

SEQ ID NO: 4888 - DNA, 14 bp, Artificial sequence
  synthetic sequence
gaggtgtagtaaca

SEQ ID NO: 4889 - DNA, 14 bp, Artificial sequence
  synthetic sequence
cgctaaatctgaag

SEQ ID NO: 4890 - DNA, 14 bp, Artificial sequence
  synthetic sequence
ctaagccgctgaat

SEQ ID NO: 4891 - DNA, 14 bp, Artificial sequence
  synthetic sequence
tctcgtaaagcgga

SEQ ID NO: 4892 - DNA, 14 bp, Artificial sequence
  synthetic sequence
acgtcatgagaatc

SEQ ID NO: 4893 - DNA, 14 bp, Artificial sequence
  synthetic sequence
gattagaaccatga

SEQ ID NO: 4894 - DNA, 14 bp, Artificial sequence
  synthetic sequence
tgagtgaagagtag

SEQ ID NO: 4895 - DNA, 14 bp, Artificial sequence
  synthetic sequence
cgcattcaaaaagt

SEQ ID NO: 4896 - DNA, 14 bp, Artificial sequence
  synthetic sequence
tcagaatacctcgc

SEQ ID NO: 4897 - DNA, 14 bp, Artificial sequence
  synthetic sequence
ccaggtaagcatct

SEQ ID NO: 4898 - DNA, 14 bp, Artificial sequence
  synthetic sequence
gtgcgggtagacgt

SEQ ID NO: 4899 - DNA, 14 bp, Artificial sequence
  synthetic sequence
tgaacgcatgctag

SEQ ID NO: 4900 - DNA, 14 bp, Artificial sequence
  synthetic sequence
cctgttaggcgaca

SEQ ID NO: 4901 - DNA, 14 bp, Artificial sequence
  synthetic sequence
agacgctatgaaat

SEQ ID NO: 4902 - DNA, 14 bp, Artificial sequence
  synthetic sequence
gcctgacaatcggt

SEQ ID NO: 4903 - DNA, 14 bp, Artificial sequence
  synthetic sequence
cgtaagcaagatta

SEQ ID NO: 4904 - DNA, 14 bp, Artificial sequence
  synthetic sequence
aagatgtccaatac

SEQ ID NO: 4905 - DNA, 14 bp, Artificial sequence
  synthetic sequence
ccgtagctaaaaat

SEQ ID NO: 4906 - DNA, 14 bp, Artificial sequence
  synthetic sequence
acccctgcaatact

SEQ ID NO: 4907 - DNA, 14 bp, Artificial sequence
  synthetic sequence
agccaacccctatt

SEQ ID NO: 4908 - DNA, 14 bp, Artificial sequence
  synthetic sequence
gatgcttagggacc

SEQ ID NO: 4909 - DNA, 14 bp, Artificial sequence
  synthetic sequence
taccagtagaagta

SEQ ID NO: 4910 - DNA, 14 bp, Artificial sequence
  synthetic sequence
ggcagccgttatag

SEQ ID NO: 4911 - DNA, 14 bp, Artificial sequence
  synthetic sequence
gctcggcttgcggg

SEQ ID NO: 4912 - DNA, 14 bp, Artificial sequence
  synthetic sequence
cgagcctcctgctg

SEQ ID NO: 4913 - DNA, 14 bp, Artificial sequence
  synthetic sequence
ttgcccactgagac

SEQ ID NO: 4914 - DNA, 14 bp, Artificial sequence
  synthetic sequence
ggcctaatgaccct

SEQ ID NO: 4915 - DNA, 14 bp, Artificial sequence
  synthetic sequence
gtagtatcggaaac

SEQ ID NO: 4916 - DNA, 14 bp, Artificial sequence
  synthetic sequence
agttacgcagtcca

SEQ ID NO: 4917 - DNA, 14 bp, Artificial sequence
  synthetic sequence
catcaagatagggt

SEQ ID NO: 4918 - DNA, 14 bp, Artificial sequence
  synthetic sequence
atcctaaccataaa

SEQ ID NO: 4919 - DNA, 14 bp, Artificial sequence
  synthetic sequence
ggcataatactcac

SEQ ID NO: 4920 - DNA, 14 bp, Artificial sequence
  synthetic sequence
tgggcctatcgggc

SEQ ID NO: 4921 - DNA, 14 bp, Artificial sequence
  synthetic sequence
taagatgaagcatg

SEQ ID NO: 4922 - DNA, 14 bp, Artificial sequence
  synthetic sequence
cgtcaaccattgaa

SEQ ID NO: 4923 - DNA, 14 bp, Artificial sequence
  synthetic sequence
acagcatcgagatt

SEQ ID NO: 4924 - DNA, 14 bp, Artificial sequence
  synthetic sequence
ggttagctgaagaa

SEQ ID NO: 4925 - DNA, 14 bp, Artificial sequence
  synthetic sequence
tagtcccagtaaga

SEQ ID NO: 4926 - DNA, 14 bp, Artificial sequence
  synthetic sequence
acgggtgccaattg

SEQ ID NO: 4927 - DNA, 14 bp, Artificial sequence
  synthetic sequence
ggcacatcgttcag

SEQ ID NO: 4928 - DNA, 14 bp, Artificial sequence
  synthetic sequence
agcaacctactata

SEQ ID NO: 4929 - DNA, 14 bp, Artificial sequence
  synthetic sequence
gagcccatctgtgg

SEQ ID NO: 4930 - DNA, 14 bp, Artificial sequence
  synthetic sequence
gacagtgtagctac

SEQ ID NO: 4931 - DNA, 14 bp, Artificial sequence
  synthetic sequence
catactggctgcgg

SEQ ID NO: 4932 - DNA, 14 bp, Artificial sequence
  synthetic sequence
gtcggctgaggaat

SEQ ID NO: 4933 - DNA, 14 bp, Artificial sequence
  synthetic sequence
aatgcgatctgagc

SEQ ID NO: 4934 - DNA, 14 bp, Artificial sequence
  synthetic sequence
gtcgcagacaagtt

SEQ ID NO: 4935 - DNA, 14 bp, Artificial sequence
  synthetic sequence
attggccccccgct

SEQ ID NO: 4936 - DNA, 14 bp, Artificial sequence
  synthetic sequence
gcgtagttaacgcg

SEQ ID NO: 4937 - DNA, 14 bp, Artificial sequence
  synthetic sequence
gggtgctaggataa

SEQ ID NO: 4938 - DNA, 14 bp, Artificial sequence
  synthetic sequence
aacactacttaacg

SEQ ID NO: 4939 - DNA, 14 bp, Artificial sequence
  synthetic sequence
tcccacacctcagt

SEQ ID NO: 4940 - DNA, 14 bp, Artificial sequence
  synthetic sequence
ttcatcgaacaaaa

SEQ ID NO: 4941 - DNA, 14 bp, Artificial sequence
  synthetic sequence
tctagcagcggctc

SEQ ID NO: 4942 - DNA, 14 bp, Artificial sequence
  synthetic sequence
cctgcccgtcatcc

SEQ ID NO: 4943 - DNA, 14 bp, Artificial sequence
  synthetic sequence
gagttgccatcaag

SEQ ID NO: 4944 - DNA, 14 bp, Artificial sequence
  synthetic sequence
tcagcccctagatg

SEQ ID NO: 4945 - DNA, 14 bp, Artificial sequence
  synthetic sequence
gtgtgcggtacaac

SEQ ID NO: 4946 - DNA, 14 bp, Artificial sequence
  synthetic sequence
ggagtgtgacatca

SEQ ID NO: 4947 - DNA, 14 bp, Artificial sequence
  synthetic sequence
attgcggcaatgca

SEQ ID NO: 4948 - DNA, 14 bp, Artificial sequence
  synthetic sequence
cccaggtttgagca

SEQ ID NO: 4949 - DNA, 14 bp, Artificial sequence
  synthetic sequence
ctccgacgataagt

SEQ ID NO: 4950 - DNA, 14 bp, Artificial sequence
  synthetic sequence
gatagcagtctcaa

SEQ ID NO: 4951 - DNA, 14 bp, Artificial sequence
  synthetic sequence
cgcctcccgtgtac

SEQ ID NO: 4952 - DNA, 14 bp, Artificial sequence
  synthetic sequence
cagctacagacatt

SEQ ID NO: 4953 - DNA, 14 bp, Artificial sequence
  synthetic sequence
tgatctcgcgcccg

SEQ ID NO: 4954 - DNA, 14 bp, Artificial sequence
  synthetic sequence
cagcctggtcataa

SEQ ID NO: 4955 - DNA, 14 bp, Artificial sequence
  synthetic sequence
tccgatcgccgcgt

SEQ ID NO: 4956 - DNA, 14 bp, Artificial sequence
  synthetic sequence
gctagcgggtgcct

SEQ ID NO: 4957 - DNA, 14 bp, Artificial sequence
  synthetic sequence
tcaaaacgttaagg

SEQ ID NO: 4958 - DNA, 14 bp, Artificial sequence
  synthetic sequence
gctggcagaatcta

SEQ ID NO: 4959 - DNA, 14 bp, Artificial sequence
  synthetic sequence
tcctggcgtccgca

SEQ ID NO: 4960 - DNA, 14 bp, Artificial sequence
  synthetic sequence
gtataacccaacct

SEQ ID NO: 4961 - DNA, 14 bp, Artificial sequence
  synthetic sequence
gaagtaccggtatg

SEQ ID NO: 4962 - DNA, 14 bp, Artificial sequence
  synthetic sequence
caagctactgcata

SEQ ID NO: 4963 - DNA, 14 bp, Artificial sequence
  synthetic sequence
aggcggtctgcctg

SEQ ID NO: 4964 - DNA, 14 bp, Artificial sequence
  synthetic sequence
acacggacggttat

SEQ ID NO: 4965 - DNA, 14 bp, Artificial sequence
  synthetic sequence
ccagttagccgctc

SEQ ID NO: 4966 - DNA, 14 bp, Artificial sequence
  synthetic sequence
taaaaatagaccct

SEQ ID NO: 4967 - DNA, 14 bp, Artificial sequence
  synthetic sequence
tcgtcagactacaa

SEQ ID NO: 4968 - DNA, 14 bp, Artificial sequence
  synthetic sequence
acatcggctcgtgg

SEQ ID NO: 4969 - DNA, 14 bp, Artificial sequence
  synthetic sequence
acgccgtttgaagc

SEQ ID NO: 4970 - DNA, 14 bp, Artificial sequence
  synthetic sequence
ctctgaggagctca

SEQ ID NO: 4971 - DNA, 14 bp, Artificial sequence
  synthetic sequence
gtcggcgtcgtaga

SEQ ID NO: 4972 - DNA, 14 bp, Artificial sequence
  synthetic sequence
tagcattcccagac

SEQ ID NO: 4973 - DNA, 14 bp, Artificial sequence
  synthetic sequence
gtagttcccggccg

SEQ ID NO: 4974 - DNA, 14 bp, Artificial sequence
  synthetic sequence
tgctgcacccaata

SEQ ID NO: 4975 - DNA, 14 bp, Artificial sequence
  synthetic sequence
caaccccttgactc

SEQ ID NO: 4976 - DNA, 14 bp, Artificial sequence
  synthetic sequence
aggtgtggactcac

SEQ ID NO: 4977 - DNA, 14 bp, Artificial sequence
  synthetic sequence
acgcctcataagct

SEQ ID NO: 4978 - DNA, 14 bp, Artificial sequence
  synthetic sequence
gagatcgatccgat

SEQ ID NO: 4979 - DNA, 14 bp, Artificial sequence
  synthetic sequence
cggctagcgggtgt

SEQ ID NO: 4980 - DNA, 14 bp, Artificial sequence
  synthetic sequence
aggccctacttcga

SEQ ID NO: 4981 - DNA, 14 bp, Artificial sequence
  synthetic sequence
gtgcataacacagt

SEQ ID NO: 4982 - DNA, 14 bp, Artificial sequence
  synthetic sequence
ttacgatgacgggc

SEQ ID NO: 4983 - DNA, 14 bp, Artificial sequence
  synthetic sequence
ttaggactcccgga

SEQ ID NO: 4984 - DNA, 14 bp, Artificial sequence
  synthetic sequence
aacacatgacgtat

SEQ ID NO: 4985 - DNA, 14 bp, Artificial sequence
  synthetic sequence
gcctgatcgatgcc

SEQ ID NO: 4986 - DNA, 14 bp, Artificial sequence
  synthetic sequence
agcctggatcgatg

SEQ ID NO: 4987 - DNA, 14 bp, Artificial sequence
  synthetic sequence
ccgttcagccaagt

SEQ ID NO: 4988 - DNA, 14 bp, Artificial sequence
  synthetic sequence
ccaatggtcacatc

SEQ ID NO: 4989 - DNA, 14 bp, Artificial sequence
  synthetic sequence
gtggagccattcgg

SEQ ID NO: 4990 - DNA, 14 bp, Artificial sequence
  synthetic sequence
tgccaggggagctt

SEQ ID NO: 4991 - DNA, 14 bp, Artificial sequence
  synthetic sequence
gatccgcaaattag

SEQ ID NO: 4992 - DNA, 14 bp, Artificial sequence
  synthetic sequence
gtctacacacatga

SEQ ID NO: 4993 - DNA, 14 bp, Artificial sequence
  synthetic sequence
gggcatataatggc

SEQ ID NO: 4994 - DNA, 14 bp, Artificial sequence
  synthetic sequence
atccgtaacgatag

SEQ ID NO: 4995 - DNA, 14 bp, Artificial sequence
  synthetic sequence
acacatttacccgg

SEQ ID NO: 4996 - DNA, 14 bp, Artificial sequence
  synthetic sequence
gtcctgtcccaaac

SEQ ID NO: 4997 - DNA, 14 bp, Artificial sequence
  synthetic sequence
gagcctgatgcgtc

SEQ ID NO: 4998 - DNA, 14 bp, Artificial sequence
  synthetic sequence
aatgttcgcagggc

SEQ ID NO: 4999 - DNA, 14 bp, Artificial sequence
  synthetic sequence
tcgcttccgggaaa

SEQ ID NO: 5000 - DNA, 14 bp, Artificial sequence
  synthetic sequence
gttagggaggcggt

SEQ ID NO: 5001 - DNA, 14 bp, Artificial sequence
  synthetic sequence
aggtgctcgatggc

SEQ ID NO: 5002 - DNA, 14 bp, Artificial sequence
  synthetic sequence
cggctatcactaca

SEQ ID NO: 5003 - DNA, 14 bp, Artificial sequence
  synthetic sequence
cgctcgagcgtatc

SEQ ID NO: 5004 - DNA, 14 bp, Artificial sequence
  synthetic sequence
acctcacatacatc

SEQ ID NO: 5005 - DNA, 14 bp, Artificial sequence
  synthetic sequence
gggaccgtccgtta

SEQ ID NO: 5006 - DNA, 14 bp, Artificial sequence
  synthetic sequence
gggtgcgcctcagt

SEQ ID NO: 5007 - DNA, 14 bp, Artificial sequence
  synthetic sequence
gggtccaatcctag

SEQ ID NO: 5008 - DNA, 14 bp, Artificial sequence
  synthetic sequence
gtgatcgtacggga

SEQ ID NO: 5009 - DNA, 14 bp, Artificial sequence
  synthetic sequence
caagcaggtatcct

SEQ ID NO: 5010 - DNA, 14 bp, Artificial sequence
  synthetic sequence
tcccctccctaagc

SEQ ID NO: 5011 - DNA, 14 bp, Artificial sequence
  synthetic sequence
tccagagacttgcg

SEQ ID NO: 5012 - DNA, 14 bp, Artificial sequence
  synthetic sequence
tcggtggatgccaa

SEQ ID NO: 5013 - DNA, 14 bp, Artificial sequence
  synthetic sequence
gctagctcggtaac

SEQ ID NO: 5014 - DNA, 14 bp, Artificial sequence
  synthetic sequence
cagaggcttgactg

SEQ ID NO: 5015 - DNA, 14 bp, Artificial sequence
  synthetic sequence
aaggtggccttacg

SEQ ID NO: 5016 - DNA, 14 bp, Artificial sequence
  synthetic sequence
tcaggtacctgcgg

SEQ ID NO: 5017 - DNA, 14 bp, Artificial sequence
  synthetic sequence
aatactaagtgaga

SEQ ID NO: 5018 - DNA, 14 bp, Artificial sequence
  synthetic sequence
taggagtagccact

SEQ ID NO: 5019 - DNA, 14 bp, Artificial sequence
  synthetic sequence
gatccctggaacat

SEQ ID NO: 5020 - DNA, 14 bp, Artificial sequence
  synthetic sequence
atgctatgcccaca

SEQ ID NO: 5021 - DNA, 14 bp, Artificial sequence
  synthetic sequence
caacagcgattgct

SEQ ID NO: 5022 - DNA, 14 bp, Artificial sequence
  synthetic sequence
gcagttaggatcaa

SEQ ID NO: 5023 - DNA, 14 bp, Artificial sequence
  synthetic sequence
gtcatggccctgcc

SEQ ID NO: 5024 - DNA, 14 bp, Artificial sequence
  synthetic sequence
tagaatgggtcaac

SEQ ID NO: 5025 - DNA, 14 bp, Artificial sequence
  synthetic sequence
gggcgattcggtac

SEQ ID NO: 5026 - DNA, 14 bp, Artificial sequence
  synthetic sequence
cagactactagctc

SEQ ID NO: 5027 - DNA, 14 bp, Artificial sequence
  synthetic sequence
ccgtcaatagtccg

SEQ ID NO: 5028 - DNA, 14 bp, Artificial sequence
  synthetic sequence
gccaagccgtaatt

SEQ ID NO: 5029 - DNA, 14 bp, Artificial sequence
  synthetic sequence
acaccaattaccat

SEQ ID NO: 5030 - DNA, 14 bp, Artificial sequence
  synthetic sequence
gcctcggtccataa

SEQ ID NO: 5031 - DNA, 14 bp, Artificial sequence
  synthetic sequence
aggaacccatcatt

SEQ ID NO: 5032 - DNA, 14 bp, Artificial sequence
  synthetic sequence
ggcgtcccgattag

SEQ ID NO: 5033 - DNA, 14 bp, Artificial sequence
  synthetic sequence
ttcaatcacacgag

SEQ ID NO: 5034 - DNA, 14 bp, Artificial sequence
  synthetic sequence
caccccttacctag

SEQ ID NO: 5035 - DNA, 14 bp, Artificial sequence
  synthetic sequence
tacggtccactgag

SEQ ID NO: 5036 - DNA, 14 bp, Artificial sequence
  synthetic sequence
agccgacactactt

SEQ ID NO: 5037 - DNA, 14 bp, Artificial sequence
  synthetic sequence
cggctaagtgtacg

SEQ ID NO: 5038 - DNA, 14 bp, Artificial sequence
  synthetic sequence
gatgtgcgctcgcg

SEQ ID NO: 5039 - DNA, 14 bp, Artificial sequence
  synthetic sequence
gacctcttaaacaa

SEQ ID NO: 5040 - DNA, 14 bp, Artificial sequence
  synthetic sequence
gccctatacgtgca

SEQ ID NO: 5041 - DNA, 14 bp, Artificial sequence
  synthetic sequence
gcccttataaggag

SEQ ID NO: 5042 - DNA, 14 bp, Artificial sequence
  synthetic sequence
cctcaaaatgtgac

SEQ ID NO: 5043 - DNA, 14 bp, Artificial sequence
  synthetic sequence
gagaattcctgggg

SEQ ID NO: 5044 - DNA, 14 bp, Artificial sequence
  synthetic sequence
gccattactgggcg

SEQ ID NO: 5045 - DNA, 14 bp, Artificial sequence
  synthetic sequence
ggtccctaggcgct

SEQ ID NO: 5046 - DNA, 14 bp, Artificial sequence
  synthetic sequence
aatgactatcgccg

SEQ ID NO: 5047 - DNA, 14 bp, Artificial sequence
  synthetic sequence
agtaccgggttagc

SEQ ID NO: 5048 - DNA, 14 bp, Artificial sequence
  synthetic sequence
ccgtccagattaaa

SEQ ID NO: 5049 - DNA, 14 bp, Artificial sequence
  synthetic sequence
tgcgccatctagaa

SEQ ID NO: 5050 - DNA, 14 bp, Artificial sequence
  synthetic sequence
tccagcgctggaat

SEQ ID NO: 5051 - DNA, 14 bp, Artificial sequence
  synthetic sequence
cgtgacgtaggcgt

SEQ ID NO: 5052 - DNA, 14 bp, Artificial sequence
  synthetic sequence
gtatatcagccaga

SEQ ID NO: 5053 - DNA, 14 bp, Artificial sequence
  synthetic sequence
ggtaggcagtgact

SEQ ID NO: 5054 - DNA, 14 bp, Artificial sequence
  synthetic sequence
gtccttaagccgcc

SEQ ID NO: 5055 - DNA, 14 bp, Artificial sequence
  synthetic sequence
catgggcgatgctg

SEQ ID NO: 5056 - DNA, 14 bp, Artificial sequence
  synthetic sequence
ggtccaaatgcatg

SEQ ID NO: 5057 - DNA, 14 bp, Artificial sequence
  synthetic sequence
taacgaccttcgaa

SEQ ID NO: 5058 - DNA, 14 bp, Artificial sequence
  synthetic sequence
tcggtaagctacgc

SEQ ID NO: 5059 - DNA, 14 bp, Artificial sequence
  synthetic sequence
ggaattccatcggc

SEQ ID NO: 5060 - DNA, 14 bp, Artificial sequence
  synthetic sequence
atcagtgtggagga

SEQ ID NO: 5061 - DNA, 14 bp, Artificial sequence
  synthetic sequence
ggcggtgccattac

SEQ ID NO: 5062 - DNA, 14 bp, Artificial sequence
  synthetic sequence
gccttcaaactaga

SEQ ID NO: 5063 - DNA, 14 bp, Artificial sequence
  synthetic sequence
ccttgcgtgcaggc

SEQ ID NO: 5064 - DNA, 14 bp, Artificial sequence
  synthetic sequence
cgttactggccacg

SEQ ID NO: 5065 - DNA, 14 bp, Artificial sequence
  synthetic sequence
gtgtacaagtagcc

SEQ ID NO: 5066 - DNA, 14 bp, Artificial sequence
  synthetic sequence
ttcggctgggccgg

SEQ ID NO: 5067 - DNA, 14 bp, Artificial sequence
  synthetic sequence
acgcgagtcatctg

SEQ ID NO: 5068 - DNA, 14 bp, Artificial sequence
  synthetic sequence
gtacacgtggctag

SEQ ID NO: 5069 - DNA, 14 bp, Artificial sequence
  synthetic sequence
taccctgatgagaa

SEQ ID NO: 5070 - DNA, 14 bp, Artificial sequence
  synthetic sequence
cctggcctggagta

SEQ ID NO: 5071 - DNA, 14 bp, Artificial sequence
  synthetic sequence
agcgaggatcactt

SEQ ID NO: 5072 - DNA, 14 bp, Artificial sequence
  synthetic sequence
tctgccgtcggcac

SEQ ID NO: 5073 - DNA, 14 bp, Artificial sequence
  synthetic sequence
ctagagataataaa

SEQ ID NO: 5074 - DNA, 14 bp, Artificial sequence
  synthetic sequence
ccgtgcgatgtgcc

SEQ ID NO: 5075 - DNA, 14 bp, Artificial sequence
  synthetic sequence
agatcgccattacg

SEQ ID NO: 5076 - DNA, 14 bp, Artificial sequence
  synthetic sequence
tgtcagcgggtcag

SEQ ID NO: 5077 - DNA, 14 bp, Artificial sequence
  synthetic sequence
gcttccagcaatac

SEQ ID NO: 5078 - DNA, 14 bp, Artificial sequence
  synthetic sequence
gcttaagaggctag

SEQ ID NO: 5079 - DNA, 14 bp, Artificial sequence
  synthetic sequence
ctttgcgccgcgga

SEQ ID NO: 5080 - DNA, 14 bp, Artificial sequence
  synthetic sequence
tagaagtgacacta

SEQ ID NO: 5081 - DNA, 14 bp, Artificial sequence
  synthetic sequence
tcgagtacggtggc

SEQ ID NO: 5082 - DNA, 14 bp, Artificial sequence
  synthetic sequence
ggtacatccgctag

SEQ ID NO: 5083 - DNA, 14 bp, Artificial sequence
  synthetic sequence
gcgctaaagtccgt

SEQ ID NO: 5084 - DNA, 14 bp, Artificial sequence
  synthetic sequence
cgtctccatcggag

SEQ ID NO: 5085 - DNA, 14 bp, Artificial sequence
  synthetic sequence
ccctaccaatgagt

SEQ ID NO: 5086 - DNA, 14 bp, Artificial sequence
  synthetic sequence
ccaccgctctgcat

SEQ ID NO: 5087 - DNA, 14 bp, Artificial sequence
  synthetic sequence
cctcaccaggctct

SEQ ID NO: 5088 - DNA, 14 bp, Artificial sequence
  synthetic sequence
gtattcacgaaaca

SEQ ID NO: 5089 - DNA, 14 bp, Artificial sequence
  synthetic sequence
ttgctaaagagccc

SEQ ID NO: 5090 - DNA, 14 bp, Artificial sequence
  synthetic sequence
gcgaccgtactgat

SEQ ID NO: 5091 - DNA, 14 bp, Artificial sequence
  synthetic sequence
cgctcgctaggata

SEQ ID NO: 5092 - DNA, 14 bp, Artificial sequence
  synthetic sequence
gaccatgttgcaag

SEQ ID NO: 5093 - DNA, 14 bp, Artificial sequence
  synthetic sequence
ccgtctgcgccagt

SEQ ID NO: 5094 - DNA, 14 bp, Artificial sequence
  synthetic sequence
catcccgattacac

SEQ ID NO: 5095 - DNA, 14 bp, Artificial sequence
  synthetic sequence
gatgaaagaggtgt

SEQ ID NO: 5096 - DNA, 14 bp, Artificial sequence
  synthetic sequence
ggtactaatcccga

SEQ ID NO: 5097 - DNA, 14 bp, Artificial sequence
  synthetic sequence
aacgttcctaagga

SEQ ID NO: 5098 - DNA, 14 bp, Artificial sequence
  synthetic sequence
aacgggtggagtat

SEQ ID NO: 5099 - DNA, 14 bp, Artificial sequence
  synthetic sequence
ggagtatgcgctgg

SEQ ID NO: 5100 - DNA, 14 bp, Artificial sequence
  synthetic sequence
atccttccgaacgg

SEQ ID NO: 5101 - DNA, 14 bp, Artificial sequence
  synthetic sequence
ccctcgctcacgta

SEQ ID NO: 5102 - DNA, 14 bp, Artificial sequence
  synthetic sequence
atacttaagggcac

SEQ ID NO: 5103 - DNA, 14 bp, Artificial sequence
  synthetic sequence
tcgtaccaaatgag

SEQ ID NO: 5104 - DNA, 14 bp, Artificial sequence
  synthetic sequence
ccccaaaggaattt

SEQ ID NO: 5105 - DNA, 14 bp, Artificial sequence
  synthetic sequence
gatccgttaaggaa

SEQ ID NO: 5106 - DNA, 14 bp, Artificial sequence
  synthetic sequence
taggcgaccccgtt

SEQ ID NO: 5107 - DNA, 14 bp, Artificial sequence
  synthetic sequence
tttacgcacggacg

SEQ ID NO: 5108 - DNA, 14 bp, Artificial sequence
  synthetic sequence
tggttgcagacaac

SEQ ID NO: 5109 - DNA, 14 bp, Artificial sequence
  synthetic sequence
aagaggtatcgtaa

SEQ ID NO: 5110 - DNA, 14 bp, Artificial sequence
  synthetic sequence
acccgtgggaagtt

SEQ ID NO: 5111 - DNA, 14 bp, Artificial sequence
  synthetic sequence
cacacgcccttgtg

SEQ ID NO: 5112 - DNA, 14 bp, Artificial sequence
  synthetic sequence
acacaactgggttg

SEQ ID NO: 5113 - DNA, 14 bp, Artificial sequence
  synthetic sequence
accaaatcaattga

SEQ ID NO: 5114 - DNA, 14 bp, Artificial sequence
  synthetic sequence
cgtgcctacgagta

SEQ ID NO: 5115 - DNA, 14 bp, Artificial sequence
  synthetic sequence
taccaccccaaatt

SEQ ID NO: 5116 - DNA, 14 bp, Artificial sequence
  synthetic sequence
atggtcccagtgac

SEQ ID NO: 5117 - DNA, 14 bp, Artificial sequence
  synthetic sequence
gaatcctggtccac

SEQ ID NO: 5118 - DNA, 14 bp, Artificial sequence
  synthetic sequence
tgcaggtcatcgag

SEQ ID NO: 5119 - DNA, 14 bp, Artificial sequence
  synthetic sequence
tagatatcgccggc

SEQ ID NO: 5120 - DNA, 14 bp, Artificial sequence
  synthetic sequence
cagccgtcgctaat

SEQ ID NO: 5121 - DNA, 14 bp, Artificial sequence
  synthetic sequence
ttgcgggagaatgg

SEQ ID NO: 5122 - DNA, 14 bp, Artificial sequence
  synthetic sequence
acgcgtagtcacgt

SEQ ID NO: 5123 - DNA, 14 bp, Artificial sequence
  synthetic sequence
cgcgactcactcat

SEQ ID NO: 5124 - DNA, 14 bp, Artificial sequence
  synthetic sequence
ctacgtaggtgaca

SEQ ID NO: 5125 - DNA, 14 bp, Artificial sequence
  synthetic sequence
ctcgcatcgcggta

SEQ ID NO: 5126 - DNA, 14 bp, Artificial sequence
  synthetic sequence
cgcttacacaactc

SEQ ID NO: 5127 - DNA, 14 bp, Artificial sequence
  synthetic sequence
tagcggaggctact

SEQ ID NO: 5128 - DNA, 14 bp, Artificial sequence
  synthetic sequence
agattggaccctca

SEQ ID NO: 5129 - DNA, 14 bp, Artificial sequence
  synthetic sequence
gccataccatactc

SEQ ID NO: 5130 - DNA, 14 bp, Artificial sequence
  synthetic sequence
gtccggcactatga

SEQ ID NO: 5131 - DNA, 14 bp, Artificial sequence
  synthetic sequence
ctaaggttcaagga

SEQ ID NO: 5132 - DNA, 14 bp, Artificial sequence
  synthetic sequence
tacgagacgtcatg

SEQ ID NO: 5133 - DNA, 14 bp, Artificial sequence
  synthetic sequence
gtatcagtcaaacg

SEQ ID NO: 5134 - DNA, 14 bp, Artificial sequence
  synthetic sequence
gtagcatgagtaca

SEQ ID NO: 5135 - DNA, 14 bp, Artificial sequence
  synthetic sequence
ggaacgatctccct

SEQ ID NO: 5136 - DNA, 14 bp, Artificial sequence
  synthetic sequence
cgcggattcgcggt

SEQ ID NO: 5137 - DNA, 14 bp, Artificial sequence
  synthetic sequence
cacgtcaaattcac

SEQ ID NO: 5138 - DNA, 14 bp, Artificial sequence
  synthetic sequence
cacatactcagatc

SEQ ID NO: 5139 - DNA, 14 bp, Artificial sequence
  synthetic sequence
acccttgaactgac

SEQ ID NO: 5140 - DNA, 14 bp, Artificial sequence
  synthetic sequence
aaaatgcgcgtggt

SEQ ID NO: 5141 - DNA, 14 bp, Artificial sequence
  synthetic sequence
gttaagacgtccga

SEQ ID NO: 5142 - DNA, 14 bp, Artificial sequence
  synthetic sequence
cgatgtcgctacgc

SEQ ID NO: 5143 - DNA, 14 bp, Artificial sequence
  synthetic sequence
gatgacggaattga

SEQ ID NO: 5144 - DNA, 14 bp, Artificial sequence
  synthetic sequence
cgctcagttaaccc

SEQ ID NO: 5145 - DNA, 14 bp, Artificial sequence
  synthetic sequence
gccgctgatgaact

SEQ ID NO: 5146 - DNA, 14 bp, Artificial sequence
  synthetic sequence
tcataagaccgtcc

SEQ ID NO: 5147 - DNA, 14 bp, Artificial sequence
  synthetic sequence
gtgacgcagagttc

SEQ ID NO: 5148 - DNA, 14 bp, Artificial sequence
  synthetic sequence
ggtgagcactccgt

SEQ ID NO: 5149 - DNA, 14 bp, Artificial sequence
  synthetic sequence
aataaggtactcag

SEQ ID NO: 5150 - DNA, 14 bp, Artificial sequence
  synthetic sequence
gtgatgtagcgcaa

SEQ ID NO: 5151 - DNA, 14 bp, Artificial sequence
  synthetic sequence
gctggcttcaagga

SEQ ID NO: 5152 - DNA, 14 bp, Artificial sequence
  synthetic sequence
caaataagtcaggt

SEQ ID NO: 5153 - DNA, 14 bp, Artificial sequence
  synthetic sequence
aaaggggaccttct

SEQ ID NO: 5154 - DNA, 14 bp, Artificial sequence
  synthetic sequence
cgaccttaggtacc

SEQ ID NO: 5155 - DNA, 14 bp, Artificial sequence
  synthetic sequence
cccggtagcgattg

SEQ ID NO: 5156 - DNA, 14 bp, Artificial sequence
  synthetic sequence
gtgactgggcggat

SEQ ID NO: 5157 - DNA, 14 bp, Artificial sequence
  synthetic sequence
ctccgcatacgcat

SEQ ID NO: 5158 - DNA, 14 bp, Artificial sequence
  synthetic sequence
aaggctaaatctaa

SEQ ID NO: 5159 - DNA, 14 bp, Artificial sequence
  synthetic sequence
ctcagctcgctaga

SEQ ID NO: 5160 - DNA, 14 bp, Artificial sequence
  synthetic sequence
ctgtgctaccgaaa

SEQ ID NO: 5161 - DNA, 14 bp, Artificial sequence
  synthetic sequence
caccagtatcgtag

SEQ ID NO: 5162 - DNA, 14 bp, Artificial sequence
  synthetic sequence
ttggcaggtacggg

SEQ ID NO: 5163 - DNA, 14 bp, Artificial sequence
  synthetic sequence
tatacataccgggg

SEQ ID NO: 5164 - DNA, 14 bp, Artificial sequence
  synthetic sequence
gagatggtgggagt

SEQ ID NO: 5165 - DNA, 14 bp, Artificial sequence
  synthetic sequence
tccttcaggaaaac

SEQ ID NO: 5166 - DNA, 14 bp, Artificial sequence
  synthetic sequence
cagacgtcgttgga

SEQ ID NO: 5167 - DNA, 14 bp, Artificial sequence
  synthetic sequence
gatactatgacgac

SEQ ID NO: 5168 - DNA, 14 bp, Artificial sequence
  synthetic sequence
cgctgctctccgag

SEQ ID NO: 5169 - DNA, 14 bp, Artificial sequence
  synthetic sequence
caatggaaagaatt

SEQ ID NO: 5170 - DNA, 14 bp, Artificial sequence
  synthetic sequence
acatgaaatctcag

SEQ ID NO: 5171 - DNA, 14 bp, Artificial sequence
  synthetic sequence
tccctgcccacgct

SEQ ID NO: 5172 - DNA, 14 bp, Artificial sequence
  synthetic sequence
cggatacctactgg

SEQ ID NO: 5173 - DNA, 14 bp, Artificial sequence
  synthetic sequence
gcactaggtatcgc

SEQ ID NO: 5174 - DNA, 14 bp, Artificial sequence
  synthetic sequence
cacagatactaata

SEQ ID NO: 5175 - DNA, 14 bp, Artificial sequence
  synthetic sequence
attcctcagcaggc

SEQ ID NO: 5176 - DNA, 14 bp, Artificial sequence
  synthetic sequence
tattcggcgagaac

SEQ ID NO: 5177 - DNA, 14 bp, Artificial sequence
  synthetic sequence
tcaccacgcaattg

SEQ ID NO: 5178 - DNA, 14 bp, Artificial sequence
  synthetic sequence
aggggcttctagca

SEQ ID NO: 5179 - DNA, 14 bp, Artificial sequence
  synthetic sequence
gaggatatggctaa

SEQ ID NO: 5180 - DNA, 14 bp, Artificial sequence
  synthetic sequence
gtcaggcgtcatgc

SEQ ID NO: 5181 - DNA, 14 bp, Artificial sequence
  synthetic sequence
tgccggtccctgcg

SEQ ID NO: 5182 - DNA, 14 bp, Artificial sequence
  synthetic sequence
ccgctgcattcagc

SEQ ID NO: 5183 - DNA, 14 bp, Artificial sequence
  synthetic sequence
aaaagcttgtagcg

SEQ ID NO: 5184 - DNA, 14 bp, Artificial sequence
  synthetic sequence
gatgggctggtaag

SEQ ID NO: 5185 - DNA, 14 bp, Artificial sequence
  synthetic sequence
cacaggcaaattct

SEQ ID NO: 5186 - DNA, 14 bp, Artificial sequence
  synthetic sequence
ttgacaatacaacc

SEQ ID NO: 5187 - DNA, 14 bp, Artificial sequence
  synthetic sequence
gcggattggtgaaa

SEQ ID NO: 5188 - DNA, 14 bp, Artificial sequence
  synthetic sequence
atgtgcccgtcgga

SEQ ID NO: 5189 - DNA, 14 bp, Artificial sequence
  synthetic sequence
gacctttggacaaa

SEQ ID NO: 5190 - DNA, 14 bp, Artificial sequence
  synthetic sequence
aacgatccatctcg

SEQ ID NO: 5191 - DNA, 14 bp, Artificial sequence
  synthetic sequence
caggcgattgcaat

SEQ ID NO: 5192 - DNA, 14 bp, Artificial sequence
  synthetic sequence
cgagtcatcgatgg

SEQ ID NO: 5193 - DNA, 14 bp, Artificial sequence
  synthetic sequence
tggaggcactggat

SEQ ID NO: 5194 - DNA, 14 bp, Artificial sequence
  synthetic sequence
atcaaagtagtcca

SEQ ID NO: 5195 - DNA, 14 bp, Artificial sequence
  synthetic sequence
ttgaagtgaaggcc

SEQ ID NO: 5196 - DNA, 14 bp, Artificial sequence
  synthetic sequence
gtgctacatcgaac

SEQ ID NO: 5197 - DNA, 14 bp, Artificial sequence
  synthetic sequence
gcggtagccccttg

SEQ ID NO: 5198 - DNA, 14 bp, Artificial sequence
  synthetic sequence
gttctgaaaccgga

SEQ ID NO: 5199 - DNA, 14 bp, Artificial sequence
  synthetic sequence
ttaaggaacatcaa

SEQ ID NO: 5200 - DNA, 14 bp, Artificial sequence
  synthetic sequence
cacctgccagtact

SEQ ID NO: 5201 - DNA, 14 bp, Artificial sequence
  synthetic sequence
ggcctgggacttac

SEQ ID NO: 5202 - DNA, 14 bp, Artificial sequence
  synthetic sequence
gtaagaccgtggat

SEQ ID NO: 5203 - DNA, 14 bp, Artificial sequence
  synthetic sequence
aggagacaggttgt

SEQ ID NO: 5204 - DNA, 14 bp, Artificial sequence
  synthetic sequence
cagagtgctcatcc

SEQ ID NO: 5205 - DNA, 14 bp, Artificial sequence
  synthetic sequence
agactccgtaccct

SEQ ID NO: 5206 - DNA, 14 bp, Artificial sequence
  synthetic sequence
agattgccccaatc

SEQ ID NO: 5207 - DNA, 14 bp, Artificial sequence
  synthetic sequence
ggaacggactggtt

SEQ ID NO: 5208 - DNA, 14 bp, Artificial sequence
  synthetic sequence
cccagctactgact

SEQ ID NO: 5209 - DNA, 14 bp, Artificial sequence
  synthetic sequence
ttctcccacgagga

SEQ ID NO: 5210 - DNA, 14 bp, Artificial sequence
  synthetic sequence
cctcagaggttaac

SEQ ID NO: 5211 - DNA, 14 bp, Artificial sequence
  synthetic sequence
acttcatgcgccaa

SEQ ID NO: 5212 - DNA, 14 bp, Artificial sequence
  synthetic sequence
tcgactagcaacgt

SEQ ID NO: 5213 - DNA, 14 bp, Artificial sequence
  synthetic sequence
gttagaagatagag

SEQ ID NO: 5214 - DNA, 14 bp, Artificial sequence
  synthetic sequence
ctgactgccagagt

SEQ ID NO: 5215 - DNA, 14 bp, Artificial sequence
  synthetic sequence
ttactagggcgacc

SEQ ID NO: 5216 - DNA, 14 bp, Artificial sequence
  synthetic sequence
gtgccatccgcctg

SEQ ID NO: 5217 - DNA, 14 bp, Artificial sequence
  synthetic sequence
cataacctcgatag

SEQ ID NO: 5218 - DNA, 14 bp, Artificial sequence
  synthetic sequence
tctaaaaacgctcg

SEQ ID NO: 5219 - DNA, 14 bp, Artificial sequence
  synthetic sequence
accttaagccggct

SEQ ID NO: 5220 - DNA, 14 bp, Artificial sequence
  synthetic sequence
accgcgtagactta

SEQ ID NO: 5221 - DNA, 14 bp, Artificial sequence
  synthetic sequence
atagagttagacgg

SEQ ID NO: 5222 - DNA, 14 bp, Artificial sequence
  synthetic sequence
ttcgccagactacg

SEQ ID NO: 5223 - DNA, 14 bp, Artificial sequence
  synthetic sequence
accgtacttcggcg

SEQ ID NO: 5224 - DNA, 14 bp, Artificial sequence
  synthetic sequence
tatacccaactcac

SEQ ID NO: 5225 - DNA, 14 bp, Artificial sequence
  synthetic sequence
tatcaccatacccc

SEQ ID NO: 5226 - DNA, 14 bp, Artificial sequence
  synthetic sequence
tgggcctagcaatg

SEQ ID NO: 5227 - DNA, 14 bp, Artificial sequence
  synthetic sequence
caatagtgcgcgct

SEQ ID NO: 5228 - DNA, 14 bp, Artificial sequence
  synthetic sequence
aactactgggatcc

SEQ ID NO: 5229 - DNA, 14 bp, Artificial sequence
  synthetic sequence
aattagggacgggt

SEQ ID NO: 5230 - DNA, 14 bp, Artificial sequence
  synthetic sequence
ggattcagagcgtc

SEQ ID NO: 5231 - DNA, 14 bp, Artificial sequence
  synthetic sequence
gtggctcgaaaatc

SEQ ID NO: 5232 - DNA, 14 bp, Artificial sequence
  synthetic sequence
cactcacgactggt

SEQ ID NO: 5233 - DNA, 14 bp, Artificial sequence
  synthetic sequence
cttatgggcaggca

SEQ ID NO: 5234 - DNA, 14 bp, Artificial sequence
  synthetic sequence
cgacttacggcact

SEQ ID NO: 5235 - DNA, 14 bp, Artificial sequence
  synthetic sequence
ctacacacgattgc

SEQ ID NO: 5236 - DNA, 14 bp, Artificial sequence
  synthetic sequence
atcgtacacacagt

SEQ ID NO: 5237 - DNA, 14 bp, Artificial sequence
  synthetic sequence
aggtaagggcagtt

SEQ ID NO: 5238 - DNA, 14 bp, Artificial sequence
  synthetic sequence
tcgcgagcctgggt

SEQ ID NO: 5239 - DNA, 14 bp, Artificial sequence
  synthetic sequence
agccgtccgacctt

SEQ ID NO: 5240 - DNA, 14 bp, Artificial sequence
  synthetic sequence
agaccggtatggat

SEQ ID NO: 5241 - DNA, 14 bp, Artificial sequence
  synthetic sequence
agtaaacaactctc

SEQ ID NO: 5242 - DNA, 14 bp, Artificial sequence
  synthetic sequence
caaacgccttcatc

SEQ ID NO: 5243 - DNA, 14 bp, Artificial sequence
  synthetic sequence
cgacccagtcactt

SEQ ID NO: 5244 - DNA, 14 bp, Artificial sequence
  synthetic sequence
caccagatactgtg

SEQ ID NO: 5245 - DNA, 14 bp, Artificial sequence
  synthetic sequence
cttgacgctcggag

SEQ ID NO: 5246 - DNA, 14 bp, Artificial sequence
  synthetic sequence
taagcgggatgtaa

SEQ ID NO: 5247 - DNA, 14 bp, Artificial sequence
  synthetic sequence
cagctaggttaaag

SEQ ID NO: 5248 - DNA, 14 bp, Artificial sequence
  synthetic sequence
caaaacgatttgcc

SEQ ID NO: 5249 - DNA, 14 bp, Artificial sequence
  synthetic sequence
cttggaggggggta

SEQ ID NO: 5250 - DNA, 14 bp, Artificial sequence
  synthetic sequence
aggcctagttaaga

SEQ ID NO: 5251 - DNA, 14 bp, Artificial sequence
  synthetic sequence
gctgcctggtcaga

SEQ ID NO: 5252 - DNA, 14 bp, Artificial sequence
  synthetic sequence
tccgataaataggg

SEQ ID NO: 5253 - DNA, 14 bp, Artificial sequence
  synthetic sequence
cgtgcaatcactgg

SEQ ID NO: 5254 - DNA, 14 bp, Artificial sequence
  synthetic sequence
acattgcccagtcg

SEQ ID NO: 5255 - DNA, 14 bp, Artificial sequence
  synthetic sequence
accgtacctgagat

SEQ ID NO: 5256 - DNA, 14 bp, Artificial sequence
  synthetic sequence
gcgcgtgttaaggc

SEQ ID NO: 5257 - DNA, 14 bp, Artificial sequence
  synthetic sequence
acaggtctctcagc

SEQ ID NO: 5258 - DNA, 14 bp, Artificial sequence
  synthetic sequence
gaagtagagtcctg

SEQ ID NO: 5259 - DNA, 14 bp, Artificial sequence
  synthetic sequence
gtgacctccgaaat

SEQ ID NO: 5260 - DNA, 14 bp, Artificial sequence
  synthetic sequence
acggtcctgatgca

SEQ ID NO: 5261 - DNA, 14 bp, Artificial sequence
  synthetic sequence
tggacgcttgaaaa

SEQ ID NO: 5262 - DNA, 14 bp, Artificial sequence
  synthetic sequence
cgtgtcgcaggtca

SEQ ID NO: 5263 - DNA, 14 bp, Artificial sequence
  synthetic sequence
acggtcaggctgat

SEQ ID NO: 5264 - DNA, 14 bp, Artificial sequence
  synthetic sequence
tccgacgtactcag

SEQ ID NO: 5265 - DNA, 14 bp, Artificial sequence
  synthetic sequence
ctcgcaaaatatac

SEQ ID NO: 5266 - DNA, 14 bp, Artificial sequence
  synthetic sequence
aagctttaacacca

SEQ ID NO: 5267 - DNA, 14 bp, Artificial sequence
  synthetic sequence
gcggctagcgtctc

SEQ ID NO: 5268 - DNA, 14 bp, Artificial sequence
  synthetic sequence
tggatccctcagga

SEQ ID NO: 5269 - DNA, 14 bp, Artificial sequence
  synthetic sequence
ctcaggctctacac

SEQ ID NO: 5270 - DNA, 14 bp, Artificial sequence
  synthetic sequence
tcctgggaccaaat

SEQ ID NO: 5271 - DNA, 14 bp, Artificial sequence
  synthetic sequence
aggtagccctctgc

SEQ ID NO: 5272 - DNA, 14 bp, Artificial sequence
  synthetic sequence
ggacgtttacagac

SEQ ID NO: 5273 - DNA, 14 bp, Artificial sequence
  synthetic sequence
acttgcgctgggac

SEQ ID NO: 5274 - DNA, 14 bp, Artificial sequence
  synthetic sequence
acgattgagccaat

SEQ ID NO: 5275 - DNA, 14 bp, Artificial sequence
  synthetic sequence
agattgcaccgcgt

SEQ ID NO: 5276 - DNA, 14 bp, Artificial sequence
  synthetic sequence
gaccgctcgttggc

SEQ ID NO: 5277 - DNA, 14 bp, Artificial sequence
  synthetic sequence
tcacaagtatacgc

SEQ ID NO: 5278 - DNA, 14 bp, Artificial sequence
  synthetic sequence
ccggctaagtcggt

SEQ ID NO: 5279 - DNA, 14 bp, Artificial sequence
  synthetic sequence
ggataatgaggctc

SEQ ID NO: 5280 - DNA, 14 bp, Artificial sequence
  synthetic sequence
actgagcccagtgt

SEQ ID NO: 5281 - DNA, 14 bp, Artificial sequence
  synthetic sequence
cagattaacaaggt

SEQ ID NO: 5282 - DNA, 14 bp, Artificial sequence
  synthetic sequence
atggacgaccgttc

SEQ ID NO: 5283 - DNA, 14 bp, Artificial sequence
  synthetic sequence
ggggactcctctca

SEQ ID NO: 5284 - DNA, 14 bp, Artificial sequence
  synthetic sequence
ccaaaagtgattga

SEQ ID NO: 5285 - DNA, 14 bp, Artificial sequence
  synthetic sequence
ggcgagttcgcctc

SEQ ID NO: 5286 - DNA, 14 bp, Artificial sequence
  synthetic sequence
atcgtacaatgcaa

SEQ ID NO: 5287 - DNA, 14 bp, Artificial sequence
  synthetic sequence
agaagtattagctc

SEQ ID NO: 5288 - DNA, 14 bp, Artificial sequence
  synthetic sequence
cgccgattattaaa

SEQ ID NO: 5289 - DNA, 14 bp, Artificial sequence
  synthetic sequence
tgcagtatcgccgt

SEQ ID NO: 5290 - DNA, 14 bp, Artificial sequence
  synthetic sequence
ctaatatcaatgca

SEQ ID NO: 5291 - DNA, 14 bp, Artificial sequence
  synthetic sequence
ggggatgatggtct

SEQ ID NO: 5292 - DNA, 14 bp, Artificial sequence
  synthetic sequence
tgtgcgcgaatctg

SEQ ID NO: 5293 - DNA, 14 bp, Artificial sequence
  synthetic sequence
ccgcttgttgcaac

SEQ ID NO: 5294 - DNA, 14 bp, Artificial sequence
  synthetic sequence
cattgggggtatca

SEQ ID NO: 5295 - DNA, 14 bp, Artificial sequence
  synthetic sequence
cataaatcaagatt

SEQ ID NO: 5296 - DNA, 14 bp, Artificial sequence
  synthetic sequence
ggccgtagtctctg

SEQ ID NO: 5297 - DNA, 14 bp, Artificial sequence
  synthetic sequence
tatatggactaaac

SEQ ID NO: 5298 - DNA, 14 bp, Artificial sequence
  synthetic sequence
taaactcctccagt

SEQ ID NO: 5299 - DNA, 14 bp, Artificial sequence
  synthetic sequence
ctcgggtaatgtcc

SEQ ID NO: 5300 - DNA, 14 bp, Artificial sequence
  synthetic sequence
gtatgtaggaccgt

SEQ ID NO: 5301 - DNA, 14 bp, Artificial sequence
  synthetic sequence
ctccatacgttaaa

SEQ ID NO: 5302 - DNA, 14 bp, Artificial sequence
  synthetic sequence
attgcagcccactt

SEQ ID NO: 5303 - DNA, 14 bp, Artificial sequence
  synthetic sequence
cacatctccgactt

SEQ ID NO: 5304 - DNA, 14 bp, Artificial sequence
  synthetic sequence
actcagcggtatgt

SEQ ID NO: 5305 - DNA, 14 bp, Artificial sequence
  synthetic sequence
atagatcgtgagta

SEQ ID NO: 5306 - DNA, 14 bp, Artificial sequence
  synthetic sequence
ttcagccatcgctg

SEQ ID NO: 5307 - DNA, 14 bp, Artificial sequence
  synthetic sequence
gtctatgccgtagc

SEQ ID NO: 5308 - DNA, 14 bp, Artificial sequence
  synthetic sequence
gccgtagttgtgcc

SEQ ID NO: 5309 - DNA, 14 bp, Artificial sequence
  synthetic sequence
actgcgcgtctagt

SEQ ID NO: 5310 - DNA, 14 bp, Artificial sequence
  synthetic sequence
tctgagttaaaggg

SEQ ID NO: 5311 - DNA, 14 bp, Artificial sequence
  synthetic sequence
ccacgcttggatat

SEQ ID NO: 5312 - DNA, 14 bp, Artificial sequence
  synthetic sequence
tgtcaatcagcatg

SEQ ID NO: 5313 - DNA, 14 bp, Artificial sequence
  synthetic sequence
actattggtaaacg

SEQ ID NO: 5314 - DNA, 14 bp, Artificial sequence
  synthetic sequence
tcgcaatgattgaa

SEQ ID NO: 5315 - DNA, 14 bp, Artificial sequence
  synthetic sequence
tcttccggactaag

SEQ ID NO: 5316 - DNA, 14 bp, Artificial sequence
  synthetic sequence
tcctggttccacca

SEQ ID NO: 5317 - DNA, 14 bp, Artificial sequence
  synthetic sequence
ctgattaggtagaa

SEQ ID NO: 5318 - DNA, 14 bp, Artificial sequence
  synthetic sequence
gtgtcatggctaag

SEQ ID NO: 5319 - DNA, 14 bp, Artificial sequence
  synthetic sequence
acgacctctaagtt

SEQ ID NO: 5320 - DNA, 14 bp, Artificial sequence
  synthetic sequence
cctagtagatgtca

SEQ ID NO: 5321 - DNA, 14 bp, Artificial sequence
  synthetic sequence
aagtagttgaaatc

SEQ ID NO: 5322 - DNA, 14 bp, Artificial sequence
  synthetic sequence
acttctgacaatgg

SEQ ID NO: 5323 - DNA, 14 bp, Artificial sequence
  synthetic sequence
ccgaattaataggt

SEQ ID NO: 5324 - DNA, 14 bp, Artificial sequence
  synthetic sequence
taccgaatcaattg

SEQ ID NO: 5325 - DNA, 14 bp, Artificial sequence
  synthetic sequence
gtcgacgtggcgtt

SEQ ID NO: 5326 - DNA, 14 bp, Artificial sequence
  synthetic sequence
tgtaatgcgagtag

SEQ ID NO: 5327 - DNA, 14 bp, Artificial sequence
  synthetic sequence
attagttcgccagg

SEQ ID NO: 5328 - DNA, 14 bp, Artificial sequence
  synthetic sequence
gtcacctgtcgata

SEQ ID NO: 5329 - DNA, 14 bp, Artificial sequence
  synthetic sequence
tttgaaagccatag

SEQ ID NO: 5330 - DNA, 14 bp, Artificial sequence
  synthetic sequence
aaccgtgtcctgtg

SEQ ID NO: 5331 - DNA, 14 bp, Artificial sequence
  synthetic sequence
ggtgcttctgagcg

SEQ ID NO: 5332 - DNA, 14 bp, Artificial sequence
  synthetic sequence
actgtctgtcccac

SEQ ID NO: 5333 - DNA, 14 bp, Artificial sequence
  synthetic sequence
actagtactcatga

SEQ ID NO: 5334 - DNA, 14 bp, Artificial sequence
  synthetic sequence
actctggtctcgag

SEQ ID NO: 5335 - DNA, 14 bp, Artificial sequence
  synthetic sequence
ctacagcatgctgt

SEQ ID NO: 5336 - DNA, 14 bp, Artificial sequence
  synthetic sequence
gtgtctcagggatg

SEQ ID NO: 5337 - DNA, 14 bp, Artificial sequence
  synthetic sequence
cgggtgtggtgctc

SEQ ID NO: 5338 - DNA, 14 bp, Artificial sequence
  synthetic sequence
cagtggtcacactt

SEQ ID NO: 5339 - DNA, 14 bp, Artificial sequence
  synthetic sequence
gcctccgcgtcttg

SEQ ID NO: 5340 - DNA, 14 bp, Artificial sequence
  synthetic sequence
tgtacgtcccatgc

SEQ ID NO: 5341 - DNA, 14 bp, Artificial sequence
  synthetic sequence
ggaataccatgtct

SEQ ID NO: 5342 - DNA, 14 bp, Artificial sequence
  synthetic sequence
gcctgatatcatcc

SEQ ID NO: 5343 - DNA, 14 bp, Artificial sequence
  synthetic sequence
ggattcgtgccggt

SEQ ID NO: 5344 - DNA, 14 bp, Artificial sequence
  synthetic sequence
tctaggcggtgata

SEQ ID NO: 5345 - DNA, 14 bp, Artificial sequence
  synthetic sequence
aatctcaaccgtat

SEQ ID NO: 5346 - DNA, 14 bp, Artificial sequence
  synthetic sequence
ataacacttccgtg

SEQ ID NO: 5347 - DNA, 14 bp, Artificial sequence
  synthetic sequence
tctgtaccgcgtcc

SEQ ID NO: 5348 - DNA, 14 bp, Artificial sequence
  synthetic sequence
attgcatatacgac

SEQ ID NO: 5349 - DNA, 14 bp, Artificial sequence
  synthetic sequence
gtggggaagtatta

SEQ ID NO: 5350 - DNA, 14 bp, Artificial sequence
  synthetic sequence
tatgaggcctgtgg

SEQ ID NO: 5351 - DNA, 14 bp, Artificial sequence
  synthetic sequence
ggtagcttcctggg

SEQ ID NO: 5352 - DNA, 14 bp, Artificial sequence
  synthetic sequence
taatcgatatagcc

SEQ ID NO: 5353 - DNA, 14 bp, Artificial sequence
  synthetic sequence
aagctcgcctcttc

SEQ ID NO: 5354 - DNA, 14 bp, Artificial sequence
  synthetic sequence
tatagtataacgca

SEQ ID NO: 5355 - DNA, 14 bp, Artificial sequence
  synthetic sequence
tcgtcagcggatgt

SEQ ID NO: 5356 - DNA, 14 bp, Artificial sequence
  synthetic sequence
cactcttgccgatc

SEQ ID NO: 5357 - DNA, 14 bp, Artificial sequence
  synthetic sequence
tttcagctccgaca

SEQ ID NO: 5358 - DNA, 14 bp, Artificial sequence
  synthetic sequence
cataccaacttaat

SEQ ID NO: 5359 - DNA, 14 bp, Artificial sequence
  synthetic sequence
tcgtaatggcctcc

SEQ ID NO: 5360 - DNA, 14 bp, Artificial sequence
  synthetic sequence
gctgcgtagaatat

SEQ ID NO: 5361 - DNA, 14 bp, Artificial sequence
  synthetic sequence
tattgccaactagg

SEQ ID NO: 5362 - DNA, 14 bp, Artificial sequence
  synthetic sequence
gtccctcgcgatct

SEQ ID NO: 5363 - DNA, 14 bp, Artificial sequence
  synthetic sequence
gcattgtccactgc

SEQ ID NO: 5364 - DNA, 14 bp, Artificial sequence
  synthetic sequence
cttgcacggtcctg

SEQ ID NO: 5365 - DNA, 14 bp, Artificial sequence
  synthetic sequence
ggctgtgtccccct

SEQ ID NO: 5366 - DNA, 14 bp, Artificial sequence
  synthetic sequence
gagtgattcgtcgg

SEQ ID NO: 5367 - DNA, 14 bp, Artificial sequence
  synthetic sequence
ttcccgtctacagg

SEQ ID NO: 5368 - DNA, 14 bp, Artificial sequence
  synthetic sequence
catattcagcgcta

SEQ ID NO: 5369 - DNA, 14 bp, Artificial sequence
  synthetic sequence
gtgttcaccgctgg

SEQ ID NO: 5370 - DNA, 14 bp, Artificial sequence
  synthetic sequence
tagacggtgtacgt

SEQ ID NO: 5371 - DNA, 14 bp, Artificial sequence
  synthetic sequence
cttggcaagttgaa

SEQ ID NO: 5372 - DNA, 14 bp, Artificial sequence
  synthetic sequence
gctgagatagttgg

SEQ ID NO: 5373 - DNA, 14 bp, Artificial sequence
  synthetic sequence
tgccattcgacagt

SEQ ID NO: 5374 - DNA, 14 bp, Artificial sequence
  synthetic sequence
aatgtgtgaactgg

SEQ ID NO: 5375 - DNA, 14 bp, Artificial sequence
  synthetic sequence
ctctgaccccggtt

SEQ ID NO: 5376 - DNA, 14 bp, Artificial sequence
  synthetic sequence
atatacgaatgatg

SEQ ID NO: 5377 - DNA, 14 bp, Artificial sequence
  synthetic sequence
ctctccttgcaaag

SEQ ID NO: 5378 - DNA, 14 bp, Artificial sequence
  synthetic sequence
gggtagttcggata

SEQ ID NO: 5379 - DNA, 14 bp, Artificial sequence
  synthetic sequence
tagtttcgcgggag

SEQ ID NO: 5380 - DNA, 14 bp, Artificial sequence
  synthetic sequence
cgactttactgagc

SEQ ID NO: 5381 - DNA, 14 bp, Artificial sequence
  synthetic sequence
tctgacgaagctta

SEQ ID NO: 5382 - DNA, 14 bp, Artificial sequence
  synthetic sequence
catcggcctttggg

SEQ ID NO: 5383 - DNA, 14 bp, Artificial sequence
  synthetic sequence
aactccccctctct

SEQ ID NO: 5384 - DNA, 14 bp, Artificial sequence
  synthetic sequence
gtcaaaattatcgg

SEQ ID NO: 5385 - DNA, 14 bp, Artificial sequence
  synthetic sequence
ttggggattaggaa

SEQ ID NO: 5386 - DNA, 14 bp, Artificial sequence
  synthetic sequence
tactggtcagtcca

SEQ ID NO: 5387 - DNA, 14 bp, Artificial sequence
  synthetic sequence
cgttgtcataagaa

SEQ ID NO: 5388 - DNA, 14 bp, Artificial sequence
  synthetic sequence
tttcggggtaacca

SEQ ID NO: 5389 - DNA, 14 bp, Artificial sequence
  synthetic sequence
atgtaccatgtaac

SEQ ID NO: 5390 - DNA, 14 bp, Artificial sequence
  synthetic sequence
tgaagacacatttc

SEQ ID NO: 5391 - DNA, 14 bp, Artificial sequence
  synthetic sequence
gagtgaaataattg

SEQ ID NO: 5392 - DNA, 14 bp, Artificial sequence
  synthetic sequence
gcgtgtatgataaa

SEQ ID NO: 5393 - DNA, 14 bp, Artificial sequence
  synthetic sequence
gaactaaatacttc

SEQ ID NO: 5394 - DNA, 14 bp, Artificial sequence
  synthetic sequence
ccgcttctcatgag

SEQ ID NO: 5395 - DNA, 14 bp, Artificial sequence
  synthetic sequence
ttacccttacgaga

SEQ ID NO: 5396 - DNA, 14 bp, Artificial sequence
  synthetic sequence
ccttacttgacaac

SEQ ID NO: 5397 - DNA, 14 bp, Artificial sequence
  synthetic sequence
tacttcgacgcatg

SEQ ID NO: 5398 - DNA, 14 bp, Artificial sequence
  synthetic sequence
aacaatttctcacg

SEQ ID NO: 5399 - DNA, 14 bp, Artificial sequence
  synthetic sequence
gcttgacctcgggt

SEQ ID NO: 5400 - DNA, 14 bp, Artificial sequence
  synthetic sequence
acgtgttggacggt

SEQ ID NO: 5401 - DNA, 14 bp, Artificial sequence
  synthetic sequence
aaagccaacttctt

SEQ ID NO: 5402 - DNA, 14 bp, Artificial sequence
  synthetic sequence
ttcagtcagtacgc

SEQ ID NO: 5403 - DNA, 14 bp, Artificial sequence
  synthetic sequence
cagctcatctacat

SEQ ID NO: 5404 - DNA, 14 bp, Artificial sequence
  synthetic sequence
atttgacaccagta

SEQ ID NO: 5405 - DNA, 14 bp, Artificial sequence
  synthetic sequence
actttcggggtaca

SEQ ID NO: 5406 - DNA, 14 bp, Artificial sequence
  synthetic sequence
gactttctccgacc

SEQ ID NO: 5407 - DNA, 14 bp, Artificial sequence
  synthetic sequence
agaattcataggct

SEQ ID NO: 5408 - DNA, 14 bp, Artificial sequence
  synthetic sequence
aagtttcggaacat

SEQ ID NO: 5409 - DNA, 14 bp, Artificial sequence
  synthetic sequence
gttaaaccatcgtg

SEQ ID NO: 5410 - DNA, 14 bp, Artificial sequence
  synthetic sequence
cctacgacttataa

SEQ ID NO: 5411 - DNA, 14 bp, Artificial sequence
  synthetic sequence
agtgtttgcgacgc

SEQ ID NO: 5412 - DNA, 14 bp, Artificial sequence
  synthetic sequence
gagctatgtatccg

SEQ ID NO: 5413 - DNA, 14 bp, Artificial sequence
  synthetic sequence
gtcaacattaatac

SEQ ID NO: 5414 - DNA, 14 bp, Artificial sequence
  synthetic sequence
gagctttggaagtc

SEQ ID NO: 5415 - DNA, 14 bp, Artificial sequence
  synthetic sequence
gtgtcgatcagcat

SEQ ID NO: 5416 - DNA, 14 bp, Artificial sequence
  synthetic sequence
gctattgggcatag

SEQ ID NO: 5417 - DNA, 14 bp, Artificial sequence
  synthetic sequence
catttccggtgaaa

SEQ ID NO: 5418 - DNA, 14 bp, Artificial sequence
  synthetic sequence
ggtctgtgtagggc

SEQ ID NO: 5419 - DNA, 14 bp, Artificial sequence
  synthetic sequence
attgacagtagcgt

SEQ ID NO: 5420 - DNA, 14 bp, Artificial sequence
  synthetic sequence
aacagctgtttacc

SEQ ID NO: 5421 - DNA, 14 bp, Artificial sequence
  synthetic sequence
ctctgcgaggattc

SEQ ID NO: 5422 - DNA, 14 bp, Artificial sequence
  synthetic sequence
aaattgagagtcat

SEQ ID NO: 5423 - DNA, 14 bp, Artificial sequence
  synthetic sequence
aggatatctacgtc

SEQ ID NO: 5424 - DNA, 14 bp, Artificial sequence
  synthetic sequence
aacgtgatattaag

SEQ ID NO: 5425 - DNA, 14 bp, Artificial sequence
  synthetic sequence
aattacagatcctc

SEQ ID NO: 5426 - DNA, 14 bp, Artificial sequence
  synthetic sequence
tgctgttaggcaag

SEQ ID NO: 5427 - DNA, 14 bp, Artificial sequence
  synthetic sequence
aaaagtcctttcaa

SEQ ID NO: 5428 - DNA, 14 bp, Artificial sequence
  synthetic sequence
tagtacgctaggct

SEQ ID NO: 5429 - DNA, 14 bp, Artificial sequence
  synthetic sequence
taggacctgtctca

SEQ ID NO: 5430 - DNA, 14 bp, Artificial sequence
  synthetic sequence
atggttcgggtagg

SEQ ID NO: 5431 - DNA, 14 bp, Artificial sequence
  synthetic sequence
cataaaggggttta

SEQ ID NO: 5432 - DNA, 14 bp, Artificial sequence
  synthetic sequence
ggcgtgactattgc

SEQ ID NO: 5433 - DNA, 14 bp, Artificial sequence
  synthetic sequence
gacgttcactcgat

SEQ ID NO: 5434 - DNA, 14 bp, Artificial sequence
  synthetic sequence
gacatttgagataa

SEQ ID NO: 5435 - DNA, 14 bp, Artificial sequence
  synthetic sequence
gacgaccctttgtc

SEQ ID NO: 5436 - DNA, 14 bp, Artificial sequence
  synthetic sequence
tgggctgttacaag

SEQ ID NO: 5437 - DNA, 14 bp, Artificial sequence
  synthetic sequence
attcaatgatccgg

SEQ ID NO: 5438 - DNA, 14 bp, Artificial sequence
  synthetic sequence
aagaagcttattgg

SEQ ID NO: 5439 - DNA, 14 bp, Artificial sequence
  synthetic sequence
cggaactgttcggt

SEQ ID NO: 5440 - DNA, 14 bp, Artificial sequence
  synthetic sequence
tcggtcaacattcc

SEQ ID NO: 5441 - DNA, 14 bp, Artificial sequence
  synthetic sequence
ttgaccctcactga

SEQ ID NO: 5442 - DNA, 14 bp, Artificial sequence
  synthetic sequence
tcccgatcagttag

SEQ ID NO: 5443 - DNA, 14 bp, Artificial sequence
  synthetic sequence
cttctcaagactcg

SEQ ID NO: 5444 - DNA, 14 bp, Artificial sequence
  synthetic sequence
attatcccaactcc

SEQ ID NO: 5445 - DNA, 14 bp, Artificial sequence
  synthetic sequence
tagctacactgcct

SEQ ID NO: 5446 - DNA, 14 bp, Artificial sequence
  synthetic sequence
ctggggttgaatag

SEQ ID NO: 5447 - DNA, 14 bp, Artificial sequence
  synthetic sequence
ctctgtccgataca

SEQ ID NO: 5448 - DNA, 14 bp, Artificial sequence
  synthetic sequence
catggtggttcgcg

SEQ ID NO: 5449 - DNA, 14 bp, Artificial sequence
  synthetic sequence
gcaacagtaatttg

SEQ ID NO: 5450 - DNA, 14 bp, Artificial sequence
  synthetic sequence
gtgcagcttgtcgc

SEQ ID NO: 5451 - DNA, 14 bp, Artificial sequence
  synthetic sequence
tcctacttagcaaa

SEQ ID NO: 5452 - DNA, 14 bp, Artificial sequence
  synthetic sequence
ataaaaagtgtcgt

SEQ ID NO: 5453 - DNA, 14 bp, Artificial sequence
  synthetic sequence
gatactcgctgatc

SEQ ID NO: 5454 - DNA, 14 bp, Artificial sequence
  synthetic sequence
cactcttagacggt

SEQ ID NO: 5455 - DNA, 14 bp, Artificial sequence
  synthetic sequence
tgccctggaggtct

SEQ ID NO: 5456 - DNA, 14 bp, Artificial sequence
  synthetic sequence
agtgaatatgatac

SEQ ID NO: 5457 - DNA, 14 bp, Artificial sequence
  synthetic sequence
ccttgggcctcgct

SEQ ID NO: 5458 - DNA, 14 bp, Artificial sequence
  synthetic sequence
tacgatgcgcgatt

SEQ ID NO: 5459 - DNA, 14 bp, Artificial sequence
  synthetic sequence
cccatcgtcgcttg

SEQ ID NO: 5460 - DNA, 14 bp, Artificial sequence
  synthetic sequence
agttgggtcggact

SEQ ID NO: 5461 - DNA, 14 bp, Artificial sequence
  synthetic sequence
cattgctcaactga

SEQ ID NO: 5462 - DNA, 14 bp, Artificial sequence
  synthetic sequence
caagagatgtattc

SEQ ID NO: 5463 - DNA, 14 bp, Artificial sequence
  synthetic sequence
gagaatagcatttg

SEQ ID NO: 5464 - DNA, 14 bp, Artificial sequence
  synthetic sequence
cgccacttgtaggt

SEQ ID NO: 5465 - DNA, 14 bp, Artificial sequence
  synthetic sequence
ctacctataacgat

SEQ ID NO: 5466 - DNA, 14 bp, Artificial sequence
  synthetic sequence
aatttggtcggcag

SEQ ID NO: 5467 - DNA, 14 bp, Artificial sequence
  synthetic sequence
cgcaggtctgggtt

SEQ ID NO: 5468 - DNA, 14 bp, Artificial sequence
  synthetic sequence
aagtaagtacttgg

SEQ ID NO: 5469 - DNA, 14 bp, Artificial sequence
  synthetic sequence
cgtaaaatatcctc

SEQ ID NO: 5470 - DNA, 14 bp, Artificial sequence
  synthetic sequence
ttagtagcctcacg

SEQ ID NO: 5471 - DNA, 14 bp, Artificial sequence
  synthetic sequence
cactggggtgtgct

SEQ ID NO: 5472 - DNA, 14 bp, Artificial sequence
  synthetic sequence
ttgtgtcggggaac

SEQ ID NO: 5473 - DNA, 14 bp, Artificial sequence
  synthetic sequence
tacgtattcgggcg

SEQ ID NO: 5474 - DNA, 14 bp, Artificial sequence
  synthetic sequence
cggagctttactag

SEQ ID NO: 5475 - DNA, 14 bp, Artificial sequence
  synthetic sequence
acggagcttatgat

SEQ ID NO: 5476 - DNA, 14 bp, Artificial sequence
  synthetic sequence
ctgtctgtgcgaaa

SEQ ID NO: 5477 - DNA, 14 bp, Artificial sequence
  synthetic sequence
gtgtggtatagcca

SEQ ID NO: 5478 - DNA, 14 bp, Artificial sequence
  synthetic sequence
gatcgtctcaggtc

SEQ ID NO: 5479 - DNA, 14 bp, Artificial sequence
  synthetic sequence
gacgggctcccttt

SEQ ID NO: 5480 - DNA, 14 bp, Artificial sequence
  synthetic sequence
aactaatgttgcag

SEQ ID NO: 5481 - DNA, 14 bp, Artificial sequence
  synthetic sequence
ttacctggccctca

SEQ ID NO: 5482 - DNA, 14 bp, Artificial sequence
  synthetic sequence
gtgtcagtgcggtg

SEQ ID NO: 5483 - DNA, 14 bp, Artificial sequence
  synthetic sequence
tgcggtcaactata

SEQ ID NO: 5484 - DNA, 14 bp, Artificial sequence
  synthetic sequence
tgacgcttcactga

SEQ ID NO: 5485 - DNA, 14 bp, Artificial sequence
  synthetic sequence
tagacgtagattaa

SEQ ID NO: 5486 - DNA, 14 bp, Artificial sequence
  synthetic sequence
tggagcacatgtta

SEQ ID NO: 5487 - DNA, 14 bp, Artificial sequence
  synthetic sequence
tgtacgcccacatt

SEQ ID NO: 5488 - DNA, 14 bp, Artificial sequence
  synthetic sequence
gcccctgatcgttg

SEQ ID NO: 5489 - DNA, 14 bp, Artificial sequence
  synthetic sequence
ttgggttacagcag

SEQ ID NO: 5490 - DNA, 14 bp, Artificial sequence
  synthetic sequence
gtgtcgctacagct

SEQ ID NO: 5491 - DNA, 14 bp, Artificial sequence
  synthetic sequence
tgccaattcagtaa

SEQ ID NO: 5492 - DNA, 14 bp, Artificial sequence
  synthetic sequence
gcgacttcgtatac

SEQ ID NO: 5493 - DNA, 14 bp, Artificial sequence
  synthetic sequence
caagccacgtgttt

SEQ ID NO: 5494 - DNA, 14 bp, Artificial sequence
  synthetic sequence
cagtctcgattacc

SEQ ID NO: 5495 - DNA, 14 bp, Artificial sequence
  synthetic sequence
gaatagacatctat

SEQ ID NO: 5496 - DNA, 14 bp, Artificial sequence
  synthetic sequence
aggcgtattagtcg

SEQ ID NO: 5497 - DNA, 14 bp, Artificial sequence
  synthetic sequence
ttgacggtcgtcca

SEQ ID NO: 5498 - DNA, 14 bp, Artificial sequence
  synthetic sequence
cataatgtaactaa

SEQ ID NO: 5499 - DNA, 14 bp, Artificial sequence
  synthetic sequence
aaagtcgttcgtaa

SEQ ID NO: 5500 - DNA, 14 bp, Artificial sequence
  synthetic sequence
gaagttgtctgcac

SEQ ID NO: 5501 - DNA, 14 bp, Artificial sequence
  synthetic sequence
ttaaacatacccta

SEQ ID NO: 5502 - DNA, 14 bp, Artificial sequence
  synthetic sequence
ttatcagcgagagt

SEQ ID NO: 5503 - DNA, 14 bp, Artificial sequence
  synthetic sequence
aacaaattcgctgt

SEQ ID NO: 5504 - DNA, 14 bp, Artificial sequence
  synthetic sequence
cgccaactcatttc

SEQ ID NO: 5505 - DNA, 14 bp, Artificial sequence
  synthetic sequence
gcatatctgcacct

SEQ ID NO: 5506 - DNA, 14 bp, Artificial sequence
  synthetic sequence
agtcggtcatgcgt

SEQ ID NO: 5507 - DNA, 14 bp, Artificial sequence
  synthetic sequence
cggtgacgttaaat

SEQ ID NO: 5508 - DNA, 14 bp, Artificial sequence
  synthetic sequence
gataattcgcgcat

SEQ ID NO: 5509 - DNA, 14 bp, Artificial sequence
  synthetic sequence
actaatctaaccct

SEQ ID NO: 5510 - DNA, 14 bp, Artificial sequence
  synthetic sequence
gtccgttcgtagca

SEQ ID NO: 5511 - DNA, 14 bp, Artificial sequence
  synthetic sequence
ggaattccgatgtg

SEQ ID NO: 5512 - DNA, 14 bp, Artificial sequence
  synthetic sequence
ttgaaccacctcgt

SEQ ID NO: 5513 - DNA, 14 bp, Artificial sequence
  synthetic sequence
tataaccgtagtga

SEQ ID NO: 5514 - DNA, 14 bp, Artificial sequence
  synthetic sequence
cttgtactaggagc

SEQ ID NO: 5515 - DNA, 14 bp, Artificial sequence
  synthetic sequence
tctgcgcgttagcg

SEQ ID NO: 5516 - DNA, 14 bp, Artificial sequence
  synthetic sequence
ctcgagtgcatatg

SEQ ID NO: 5517 - DNA, 14 bp, Artificial sequence
  synthetic sequence
ctattgcatcgaaa

SEQ ID NO: 5518 - DNA, 14 bp, Artificial sequence
  synthetic sequence
ggtggttagtaaga

SEQ ID NO: 5519 - DNA, 14 bp, Artificial sequence
  synthetic sequence
actacagtgttaca

SEQ ID NO: 5520 - DNA, 14 bp, Artificial sequence
  synthetic sequence
gcatcacaattact

SEQ ID NO: 5521 - DNA, 14 bp, Artificial sequence
  synthetic sequence
gggtgtgacagttg

SEQ ID NO: 5522 - DNA, 14 bp, Artificial sequence
  synthetic sequence
ttagccgtgccgta

SEQ ID NO: 5523 - DNA, 14 bp, Artificial sequence
  synthetic sequence
acatggaacatctt

SEQ ID NO: 5524 - DNA, 14 bp, Artificial sequence
  synthetic sequence
ctgggactatgctc

SEQ ID NO: 5525 - DNA, 14 bp, Artificial sequence
  synthetic sequence
tgtcacggtaccgt

SEQ ID NO: 5526 - DNA, 14 bp, Artificial sequence
  synthetic sequence
atactctcggtccc

SEQ ID NO: 5527 - DNA, 14 bp, Artificial sequence
  synthetic sequence
tatcaactaagact

SEQ ID NO: 5528 - DNA, 14 bp, Artificial sequence
  synthetic sequence
attgggggatgagt

SEQ ID NO: 5529 - DNA, 14 bp, Artificial sequence
  synthetic sequence
ctcaatgctagtgg

SEQ ID NO: 5530 - DNA, 14 bp, Artificial sequence
  synthetic sequence
ttggctccgagtac

SEQ ID NO: 5531 - DNA, 14 bp, Artificial sequence
  synthetic sequence
atggaatagagtat

SEQ ID NO: 5532 - DNA, 14 bp, Artificial sequence
  synthetic sequence
cactgaatggtctg

SEQ ID NO: 5533 - DNA, 14 bp, Artificial sequence
  synthetic sequence
tggaacgctcatat

SEQ ID NO: 5534 - DNA, 14 bp, Artificial sequence
  synthetic sequence
attcacgagagtct

SEQ ID NO: 5535 - DNA, 14 bp, Artificial sequence
  synthetic sequence
atgggatgctgcgt

SEQ ID NO: 5536 - DNA, 14 bp, Artificial sequence
  synthetic sequence
acatgaagcttatc

SEQ ID NO: 5537 - DNA, 14 bp, Artificial sequence
  synthetic sequence
cgactgttccataa

SEQ ID NO: 5538 - DNA, 14 bp, Artificial sequence
  synthetic sequence
ctggagataactct

SEQ ID NO: 5539 - DNA, 14 bp, Artificial sequence
  synthetic sequence
tgtgcagaataagt

SEQ ID NO: 5540 - DNA, 14 bp, Artificial sequence
  synthetic sequence
atcgcgttccgtca

SEQ ID NO: 5541 - DNA, 14 bp, Artificial sequence
  synthetic sequence
cacgggttgctata

SEQ ID NO: 5542 - DNA, 14 bp, Artificial sequence
  synthetic sequence
caatctaccttaag

SEQ ID NO: 5543 - DNA, 14 bp, Artificial sequence
  synthetic sequence
gctccattctgacg

SEQ ID NO: 5544 - DNA, 14 bp, Artificial sequence
  synthetic sequence
ggttgcagacttgc

SEQ ID NO: 5545 - DNA, 14 bp, Artificial sequence
  synthetic sequence
ccaagtttataagg

SEQ ID NO: 5546 - DNA, 14 bp, Artificial sequence
  synthetic sequence
ggttcatgctacgc

SEQ ID NO: 5547 - DNA, 14 bp, Artificial sequence
  synthetic sequence
cttgataccaatgg

SEQ ID NO: 5548 - DNA, 14 bp, Artificial sequence
  synthetic sequence
gcttactgcgcatg

SEQ ID NO: 5549 - DNA, 14 bp, Artificial sequence
  synthetic sequence
atgatctgtggcca

SEQ ID NO: 5550 - DNA, 14 bp, Artificial sequence
  synthetic sequence
gggcttgtggtgcg

SEQ ID NO: 5551 - DNA, 14 bp, Artificial sequence
  synthetic sequence
ccagtactcatgta

SEQ ID NO: 5552 - DNA, 14 bp, Artificial sequence
  synthetic sequence
gtggaaaatggttg

SEQ ID NO: 5553 - DNA, 14 bp, Artificial sequence
  synthetic sequence
gtcaagcatgcgtt

SEQ ID NO: 5554 - DNA, 14 bp, Artificial sequence
  synthetic sequence
tccaaattaactac

SEQ ID NO: 5555 - DNA, 14 bp, Artificial sequence
  synthetic sequence
tcgaattatcgcag

SEQ ID NO: 5556 - DNA, 14 bp, Artificial sequence
  synthetic sequence
tctcgctacggcct

SEQ ID NO: 5557 - DNA, 14 bp, Artificial sequence
  synthetic sequence
tggtgtgcaggtaa

SEQ ID NO: 5558 - DNA, 14 bp, Artificial sequence
  synthetic sequence
atctcataatcaaa

SEQ ID NO: 5559 - DNA, 14 bp, Artificial sequence
  synthetic sequence
tgctaaactagata

SEQ ID NO: 5560 - DNA, 14 bp, Artificial sequence
  synthetic sequence
actcagaatgtctg

SEQ ID NO: 5561 - DNA, 14 bp, Artificial sequence
  synthetic sequence
tggtcggcgtactc

SEQ ID NO: 5562 - DNA, 14 bp, Artificial sequence
  synthetic sequence
cgcacttttacccg

SEQ ID NO: 5563 - DNA, 14 bp, Artificial sequence
  synthetic sequence
tccattaaggatcc

SEQ ID NO: 5564 - DNA, 14 bp, Artificial sequence
  synthetic sequence
cgcattgttgcgag

SEQ ID NO: 5565 - DNA, 14 bp, Artificial sequence
  synthetic sequence
ataattagaggatc

SEQ ID NO: 5566 - DNA, 14 bp, Artificial sequence
  synthetic sequence
aagttatccgccta

SEQ ID NO: 5567 - DNA, 14 bp, Artificial sequence
  synthetic sequence
tataatctgccccc

SEQ ID NO: 5568 - DNA, 14 bp, Artificial sequence
  synthetic sequence
ttggcatcaaaggt

SEQ ID NO: 5569 - DNA, 14 bp, Artificial sequence
  synthetic sequence
gttcataacaatac

SEQ ID NO: 5570 - DNA, 14 bp, Artificial sequence
  synthetic sequence
ccggacgaatgttt

SEQ ID NO: 5571 - DNA, 14 bp, Artificial sequence
  synthetic sequence
ccactacacgttgt

SEQ ID NO: 5572 - DNA, 14 bp, Artificial sequence
  synthetic sequence
gtgcggagcggttt

SEQ ID NO: 5573 - DNA, 14 bp, Artificial sequence
  synthetic sequence
ctcataaagccttc

SEQ ID NO: 5574 - DNA, 14 bp, Artificial sequence
  synthetic sequence
tagtctatcaggga

SEQ ID NO: 5575 - DNA, 14 bp, Artificial sequence
  synthetic sequence
ctacactaccattc

SEQ ID NO: 5576 - DNA, 14 bp, Artificial sequence
  synthetic sequence
tgccacggtcagtt

SEQ ID NO: 5577 - DNA, 14 bp, Artificial sequence
  synthetic sequence
tttagaactcggcg

SEQ ID NO: 5578 - DNA, 14 bp, Artificial sequence
  synthetic sequence
tcagaattgctaag

SEQ ID NO: 5579 - DNA, 14 bp, Artificial sequence
  synthetic sequence
ttaaatatgcacag

SEQ ID NO: 5580 - DNA, 14 bp, Artificial sequence
  synthetic sequence
tattccacgatgga

SEQ ID NO: 5581 - DNA, 14 bp, Artificial sequence
  synthetic sequence
attggcgcatatag

SEQ ID NO: 5582 - DNA, 14 bp, Artificial sequence
  synthetic sequence
ttaataaagtcgag

SEQ ID NO: 5583 - DNA, 14 bp, Artificial sequence
  synthetic sequence
tctcaaaacacctt

SEQ ID NO: 5584 - DNA, 14 bp, Artificial sequence
  synthetic sequence
gattggcataaagt

SEQ ID NO: 5585 - DNA, 14 bp, Artificial sequence
  synthetic sequence
atggtggatagact

SEQ ID NO: 5586 - DNA, 14 bp, Artificial sequence
  synthetic sequence
tgcgtcgcatgtgg

SEQ ID NO: 5587 - DNA, 14 bp, Artificial sequence
  synthetic sequence
agctccgtcctatg

SEQ ID NO: 5588 - DNA, 14 bp, Artificial sequence
  synthetic sequence
atgtaagagacctt

SEQ ID NO: 5589 - DNA, 14 bp, Artificial sequence
  synthetic sequence
cgagcatcctctct

SEQ ID NO: 5590 - DNA, 14 bp, Artificial sequence
  synthetic sequence
cgaccgtctttccg

SEQ ID NO: 5591 - DNA, 14 bp, Artificial sequence
  synthetic sequence
cttagtccctacca

SEQ ID NO: 5592 - DNA, 14 bp, Artificial sequence
  synthetic sequence
ctcagagtagggtt

SEQ ID NO: 5593 - DNA, 14 bp, Artificial sequence
  synthetic sequence
tagccacttccgct

SEQ ID NO: 5594 - DNA, 14 bp, Artificial sequence
  synthetic sequence
gtatcttcggacaa

SEQ ID NO: 5595 - DNA, 14 bp, Artificial sequence
  synthetic sequence
gaccgttcataatc

SEQ ID NO: 5596 - DNA, 14 bp, Artificial sequence
  synthetic sequence
tgataggagtgcgt

SEQ ID NO: 5597 - DNA, 14 bp, Artificial sequence
  synthetic sequence
agtcctgtgctaac

SEQ ID NO: 5598 - DNA, 14 bp, Artificial sequence
  synthetic sequence
gtccgtagttgagc

SEQ ID NO: 5599 - DNA, 14 bp, Artificial sequence
  synthetic sequence
ggtgacgtcactgt

SEQ ID NO: 5600 - DNA, 14 bp, Artificial sequence
  synthetic sequence
ttgtatcgggccgg

SEQ ID NO: 5601 - DNA, 14 bp, Artificial sequence
  synthetic sequence
atatgaaggtaggt

SEQ ID NO: 5602 - DNA, 14 bp, Artificial sequence
  synthetic sequence
tagacctggcgttg

SEQ ID NO: 5603 - DNA, 14 bp, Artificial sequence
  synthetic sequence
agatagaaccattt

SEQ ID NO: 5604 - DNA, 14 bp, Artificial sequence
  synthetic sequence
ttgttggagcggcc

SEQ ID NO: 5605 - DNA, 14 bp, Artificial sequence
  synthetic sequence
ttgcggtctcacga

SEQ ID NO: 5606 - DNA, 14 bp, Artificial sequence
  synthetic sequence
ccaacacttttagc

SEQ ID NO: 5607 - DNA, 14 bp, Artificial sequence
  synthetic sequence
ttccaccaaatgta

SEQ ID NO: 5608 - DNA, 14 bp, Artificial sequence
  synthetic sequence
catatgactaccct

SEQ ID NO: 5609 - DNA, 14 bp, Artificial sequence
  synthetic sequence
gcccgttcaagtgt

SEQ ID NO: 5610 - DNA, 14 bp, Artificial sequence
  synthetic sequence
aagtgtagcttacg

SEQ ID NO: 5611 - DNA, 14 bp, Artificial sequence
  synthetic sequence
cactcgtcctgcta

SEQ ID NO: 5612 - DNA, 14 bp, Artificial sequence
  synthetic sequence
ataaccgttaaagt

SEQ ID NO: 5613 - DNA, 14 bp, Artificial sequence
  synthetic sequence
tctctgaaggtccc

SEQ ID NO: 5614 - DNA, 14 bp, Artificial sequence
  synthetic sequence
tcacagggctgttc

SEQ ID NO: 5615 - DNA, 14 bp, Artificial sequence
  synthetic sequence
aagtataaccctgt

SEQ ID NO: 5616 - DNA, 14 bp, Artificial sequence
  synthetic sequence
ccactctcctctaa

SEQ ID NO: 5617 - DNA, 14 bp, Artificial sequence
  synthetic sequence
gtagcctttcacac

SEQ ID NO: 5618 - DNA, 14 bp, Artificial sequence
  synthetic sequence
tgtctcgcgtacac

SEQ ID NO: 5619 - DNA, 14 bp, Artificial sequence
  synthetic sequence
cgttgactccgagt

SEQ ID NO: 5620 - DNA, 14 bp, Artificial sequence
  synthetic sequence
taactggtcgccta

SEQ ID NO: 5621 - DNA, 14 bp, Artificial sequence
  synthetic sequence
aaatcggttatgga

SEQ ID NO: 5622 - DNA, 14 bp, Artificial sequence
  synthetic sequence
atgtataccactcg

SEQ ID NO: 5623 - DNA, 14 bp, Artificial sequence
  synthetic sequence
cttgtaagatgacg

SEQ ID NO: 5624 - DNA, 14 bp, Artificial sequence
  synthetic sequence
gccacgttccgatt

SEQ ID NO: 5625 - DNA, 14 bp, Artificial sequence
  synthetic sequence
ctatgcggtaaatg

SEQ ID NO: 5626 - DNA, 14 bp, Artificial sequence
  synthetic sequence
atttaggtaagacg

SEQ ID NO: 5627 - DNA, 14 bp, Artificial sequence
  synthetic sequence
atgacacttgaact

SEQ ID NO: 5628 - DNA, 14 bp, Artificial sequence
  synthetic sequence
cgtttatgacgagg

SEQ ID NO: 5629 - DNA, 14 bp, Artificial sequence
  synthetic sequence
ctgtactacaatag

SEQ ID NO: 5630 - DNA, 14 bp, Artificial sequence
  synthetic sequence
ctatgaactaactc

SEQ ID NO: 5631 - DNA, 14 bp, Artificial sequence
  synthetic sequence
cttgagatgtaagg

SEQ ID NO: 5632 - DNA, 14 bp, Artificial sequence
  synthetic sequence
accccaaccttttc

SEQ ID NO: 5633 - DNA, 14 bp, Artificial sequence
  synthetic sequence
gttccgagagattg

SEQ ID NO: 5634 - DNA, 14 bp, Artificial sequence
  synthetic sequence
tccgaaatttcgcc

SEQ ID NO: 5635 - DNA, 14 bp, Artificial sequence
  synthetic sequence
acggtaaataatct

SEQ ID NO: 5636 - DNA, 14 bp, Artificial sequence
  synthetic sequence
tggtgagcgctaat

SEQ ID NO: 5637 - DNA, 14 bp, Artificial sequence
  synthetic sequence
gtgagaccggtttc

SEQ ID NO: 5638 - DNA, 14 bp, Artificial sequence
  synthetic sequence
gtactagggatatg

SEQ ID NO: 5639 - DNA, 14 bp, Artificial sequence
  synthetic sequence
gatcgtctaccggt

SEQ ID NO: 5640 - DNA, 14 bp, Artificial sequence
  synthetic sequence
attgaatgtgaggg

SEQ ID NO: 5641 - DNA, 14 bp, Artificial sequence
  synthetic sequence
ttgcgagctctccc

SEQ ID NO: 5642 - DNA, 14 bp, Artificial sequence
  synthetic sequence
atttgctccaagcc

SEQ ID NO: 5643 - DNA, 14 bp, Artificial sequence
  synthetic sequence
cgcatctgatgatg

SEQ ID NO: 5644 - DNA, 14 bp, Artificial sequence
  synthetic sequence
tcgggatcctgtca

SEQ ID NO: 5645 - DNA, 14 bp, Artificial sequence
  synthetic sequence
cactaactcttaga

SEQ ID NO: 5646 - DNA, 14 bp, Artificial sequence
  synthetic sequence
ggttgtgccatcgg

SEQ ID NO: 5647 - DNA, 14 bp, Artificial sequence
  synthetic sequence
ccgccatatcgatt

SEQ ID NO: 5648 - DNA, 14 bp, Artificial sequence
  synthetic sequence
agaccgttgatctg

SEQ ID NO: 5649 - DNA, 14 bp, Artificial sequence
  synthetic sequence
cccctcctgtatgg

SEQ ID NO: 5650 - DNA, 14 bp, Artificial sequence
  synthetic sequence
cccttcaggtgact

SEQ ID NO: 5651 - DNA, 14 bp, Artificial sequence
  synthetic sequence
tgacatggccgtgt

SEQ ID NO: 5652 - DNA, 14 bp, Artificial sequence
  synthetic sequence
gaatagtgttgacc

SEQ ID NO: 5653 - DNA, 14 bp, Artificial sequence
  synthetic sequence
ccattgatggccta

SEQ ID NO: 5654 - DNA, 14 bp, Artificial sequence
  synthetic sequence
tgaccgtattgcaa

SEQ ID NO: 5655 - DNA, 14 bp, Artificial sequence
  synthetic sequence
gctcccccagtgtt

SEQ ID NO: 5656 - DNA, 14 bp, Artificial sequence
  synthetic sequence
aggcatattgtcga

SEQ ID NO: 5657 - DNA, 14 bp, Artificial sequence
  synthetic sequence
tacgaaagattgtc

SEQ ID NO: 5658 - DNA, 14 bp, Artificial sequence
  synthetic sequence
gtctacacatgact

SEQ ID NO: 5659 - DNA, 14 bp, Artificial sequence
  synthetic sequence
accctttaacgcgt

SEQ ID NO: 5660 - DNA, 14 bp, Artificial sequence
  synthetic sequence
agccatcttgtacc

SEQ ID NO: 5661 - DNA, 14 bp, Artificial sequence
  synthetic sequence
gcccattcatatcg

SEQ ID NO: 5662 - DNA, 14 bp, Artificial sequence
  synthetic sequence
ctaccatgctgcct

SEQ ID NO: 5663 - DNA, 14 bp, Artificial sequence
  synthetic sequence
tggcggaattgtca

SEQ ID NO: 5664 - DNA, 14 bp, Artificial sequence
  synthetic sequence
aagttccttgaaag

SEQ ID NO: 5665 - DNA, 14 bp, Artificial sequence
  synthetic sequence
acttcgctacactc

SEQ ID NO: 5666 - DNA, 14 bp, Artificial sequence
  synthetic sequence
ctgttcatgagcaa

SEQ ID NO: 5667 - DNA, 14 bp, Artificial sequence
  synthetic sequence
gcctactttaaggc

SEQ ID NO: 5668 - DNA, 14 bp, Artificial sequence
  synthetic sequence
ctatggctccacgt

SEQ ID NO: 5669 - DNA, 14 bp, Artificial sequence
  synthetic sequence
cggcctcaattcct

SEQ ID NO: 5670 - DNA, 14 bp, Artificial sequence
  synthetic sequence
cactgaagcttcct

SEQ ID NO: 5671 - DNA, 14 bp, Artificial sequence
  synthetic sequence
cgatctaagtgtgg

SEQ ID NO: 5672 - DNA, 14 bp, Artificial sequence
  synthetic sequence
ctgtcaatgggctc

SEQ ID NO: 5673 - DNA, 14 bp, Artificial sequence
  synthetic sequence
gcctcgttcctggg

SEQ ID NO: 5674 - DNA, 14 bp, Artificial sequence
  synthetic sequence
caattccattatgc

SEQ ID NO: 5675 - DNA, 14 bp, Artificial sequence
  synthetic sequence
tcatactgcttggg

SEQ ID NO: 5676 - DNA, 14 bp, Artificial sequence
  synthetic sequence
gtttagttcccgaa

SEQ ID NO: 5677 - DNA, 14 bp, Artificial sequence
  synthetic sequence
ttcggtggtaaatc

SEQ ID NO: 5678 - DNA, 14 bp, Artificial sequence
  synthetic sequence
tcctccgctctgtg

SEQ ID NO: 5679 - DNA, 14 bp, Artificial sequence
  synthetic sequence
tggcgtctgtcgct

SEQ ID NO: 5680 - DNA, 14 bp, Artificial sequence
  synthetic sequence
tactaggttcaata

SEQ ID NO: 5681 - DNA, 14 bp, Artificial sequence
  synthetic sequence
gtattagggagtct

SEQ ID NO: 5682 - DNA, 14 bp, Artificial sequence
  synthetic sequence
cgaattttaaagat

SEQ ID NO: 5683 - DNA, 14 bp, Artificial sequence
  synthetic sequence
atcccttgtaatcg

SEQ ID NO: 5684 - DNA, 14 bp, Artificial sequence
  synthetic sequence
ctgtggcattagct

SEQ ID NO: 5685 - DNA, 14 bp, Artificial sequence
  synthetic sequence
ttatggtaatggac

SEQ ID NO: 5686 - DNA, 14 bp, Artificial sequence
  synthetic sequence
tcagtgttccccct

SEQ ID NO: 5687 - DNA, 14 bp, Artificial sequence
  synthetic sequence
taatcgtgggtatg

SEQ ID NO: 5688 - DNA, 14 bp, Artificial sequence
  synthetic sequence
attattcgtcacaa

SEQ ID NO: 5689 - DNA, 14 bp, Artificial sequence
  synthetic sequence
tatcgtagctgcct

SEQ ID NO: 5690 - DNA, 14 bp, Artificial sequence
  synthetic sequence
tccgatactctcct

SEQ ID NO: 5691 - DNA, 14 bp, Artificial sequence
  synthetic sequence
cagaactttagtgt

SEQ ID NO: 5692 - DNA, 14 bp, Artificial sequence
  synthetic sequence
gcggcaatttaatt

SEQ ID NO: 5693 - DNA, 14 bp, Artificial sequence
  synthetic sequence
accgccatgttttg

SEQ ID NO: 5694 - DNA, 14 bp, Artificial sequence
  synthetic sequence
gcttgtgaatcatc

SEQ ID NO: 5695 - DNA, 14 bp, Artificial sequence
  synthetic sequence
tttgttaccggagc

SEQ ID NO: 5696 - DNA, 14 bp, Artificial sequence
  synthetic sequence
gtattcgactagtc

SEQ ID NO: 5697 - DNA, 14 bp, Artificial sequence
  synthetic sequence
ttgtaaaacatgtg

SEQ ID NO: 5698 - DNA, 14 bp, Artificial sequence
  synthetic sequence
gtggacttctcatc

SEQ ID NO: 5699 - DNA, 14 bp, Artificial sequence
  synthetic sequence
gtccgtggtgtcct

SEQ ID NO: 5700 - DNA, 14 bp, Artificial sequence
  synthetic sequence
tctccgctttcccc

SEQ ID NO: 5701 - DNA, 14 bp, Artificial sequence
  synthetic sequence
ttttagcgcgactc

SEQ ID NO: 5702 - DNA, 14 bp, Artificial sequence
  synthetic sequence
tgtgcgatcaatct

SEQ ID NO: 5703 - DNA, 14 bp, Artificial sequence
  synthetic sequence
tctgctcatataaa

SEQ ID NO: 5704 - DNA, 14 bp, Artificial sequence
  synthetic sequence
gttagtatccctga

SEQ ID NO: 5705 - DNA, 14 bp, Artificial sequence
  synthetic sequence
gattaattggagct

SEQ ID NO: 5706 - DNA, 14 bp, Artificial sequence
  synthetic sequence
tacactctaatctc

SEQ ID NO: 5707 - DNA, 14 bp, Artificial sequence
  synthetic sequence
ttcgggatggttcc

SEQ ID NO: 5708 - DNA, 14 bp, Artificial sequence
  synthetic sequence
tagacaactttatc

SEQ ID NO: 5709 - DNA, 14 bp, Artificial sequence
  synthetic sequence
tgactatcatacta

SEQ ID NO: 5710 - DNA, 14 bp, Artificial sequence
  synthetic sequence
gtaatgcctgtctc

SEQ ID NO: 5711 - DNA, 14 bp, Artificial sequence
  synthetic sequence
ctttagttgggcaa

SEQ ID NO: 5712 - DNA, 14 bp, Artificial sequence
  synthetic sequence
taatgcgtatataa

SEQ ID NO: 5713 - DNA, 14 bp, Artificial sequence
  synthetic sequence
gatgccaatatgtt

SEQ ID NO: 5714 - DNA, 14 bp, Artificial sequence
  synthetic sequence
agtattcatgcctc

SEQ ID NO: 5715 - DNA, 14 bp, Artificial sequence
  synthetic sequence
ccttctcgcctgtc

SEQ ID NO: 5716 - DNA, 14 bp, Artificial sequence
  synthetic sequence
atatgagtggtagt

SEQ ID NO: 5717 - DNA, 14 bp, Artificial sequence
  synthetic sequence
tgcactttatggcg

SEQ ID NO: 5718 - DNA, 14 bp, Artificial sequence
  synthetic sequence
actatcatatgtgg

SEQ ID NO: 5719 - DNA, 14 bp, Artificial sequence
  synthetic sequence
cttccttagcacta

SEQ ID NO: 5720 - DNA, 14 bp, Artificial sequence
  synthetic sequence
tcaattatctaccc

SEQ ID NO: 5721 - DNA, 14 bp, Artificial sequence
  synthetic sequence
agtcaataaagttt

SEQ ID NO: 5722 - DNA, 14 bp, Artificial sequence
  synthetic sequence
tgtaacccgtatta

SEQ ID NO: 5723 - DNA, 14 bp, Artificial sequence
  synthetic sequence
aagtctacgatttc

SEQ ID NO: 5724 - DNA, 14 bp, Artificial sequence
  synthetic sequence
gcgtcctcctatct

SEQ ID NO: 5725 - DNA, 14 bp, Artificial sequence
  synthetic sequence
ggcaggttatgtgt

SEQ ID NO: 5726 - DNA, 14 bp, Artificial sequence
  synthetic sequence
gagtatcattatcc

SEQ ID NO: 5727 - DNA, 14 bp, Artificial sequence
  synthetic sequence
tttagccagacgtt

SEQ ID NO: 5728 - DNA, 14 bp, Artificial sequence
  synthetic sequence
cgcactttttaaga

SEQ ID NO: 5729 - DNA, 14 bp, Artificial sequence
  synthetic sequence
ttaactggtgcgtc

SEQ ID NO: 5730 - DNA, 14 bp, Artificial sequence
  synthetic sequence
cattactgtaatgg

SEQ ID NO: 5731 - DNA, 14 bp, Artificial sequence
  synthetic sequence
aatatctggctatc

SEQ ID NO: 5732 - DNA, 14 bp, Artificial sequence
  synthetic sequence
cttctagtggctgg

SEQ ID NO: 5733 - DNA, 14 bp, Artificial sequence
  synthetic sequence
catgtcatgccgtt

SEQ ID NO: 5734 - DNA, 14 bp, Artificial sequence
  synthetic sequence
cggttgggtttcca

SEQ ID NO: 5735 - DNA, 14 bp, Artificial sequence
  synthetic sequence
ggtggccaatttat

SEQ ID NO: 5736 - DNA, 14 bp, Artificial sequence
  synthetic sequence
tatcggtcgcgtct

SEQ ID NO: 5737 - DNA, 14 bp, Artificial sequence
  synthetic sequence
gtcatgtcatgatc

SEQ ID NO: 5738 - DNA, 14 bp, Artificial sequence
  synthetic sequence
ctgcgagtgcttat

SEQ ID NO: 5739 - DNA, 14 bp, Artificial sequence
  synthetic sequence
tacatagtctcata

SEQ ID NO: 5740 - DNA, 14 bp, Artificial sequence
  synthetic sequence
ggactcgtctctat

SEQ ID NO: 5741 - DNA, 14 bp, Artificial sequence
  synthetic sequence
ggggtactgttcat

SEQ ID NO: 5742 - DNA, 14 bp, Artificial sequence
  synthetic sequence
ctctgtgcccattg

SEQ ID NO: 5743 - DNA, 14 bp, Artificial sequence
  synthetic sequence
acgtttgatatgag

SEQ ID NO: 5744 - DNA, 14 bp, Artificial sequence
  synthetic sequence
catactatatacta

SEQ ID NO: 5745 - DNA, 14 bp, Artificial sequence
  synthetic sequence
tttggcagttcaca

SEQ ID NO: 5746 - DNA, 14 bp, Artificial sequence
  synthetic sequence
atcgtgttcgacat

SEQ ID NO: 5747 - DNA, 14 bp, Artificial sequence
  synthetic sequence
aacgtgtctcgttc

SEQ ID NO: 5748 - DNA, 14 bp, Artificial sequence
  synthetic sequence
ggacgtattgtata

SEQ ID NO: 5749 - DNA, 14 bp, Artificial sequence
  synthetic sequence
caatagtattagta

SEQ ID NO: 5750 - DNA, 14 bp, Artificial sequence
  synthetic sequence
tggtaccttggcta

SEQ ID NO: 5751 - DNA, 14 bp, Artificial sequence
  synthetic sequence
tacgattttacgag

SEQ ID NO: 5752 - DNA, 14 bp, Artificial sequence
  synthetic sequence
tttcactacacgat

SEQ ID NO: 5753 - DNA, 14 bp, Artificial sequence
  synthetic sequence
agattcgcgttctc

SEQ ID NO: 5754 - DNA, 14 bp, Artificial sequence
  synthetic sequence
gtatttgagtcacg

SEQ ID NO: 5755 - DNA, 14 bp, Artificial sequence
  synthetic sequence
cagttattatcgac

SEQ ID NO: 5756 - DNA, 14 bp, Artificial sequence
  synthetic sequence
attcggtcgactta

SEQ ID NO: 5757 - DNA, 14 bp, Artificial sequence
  synthetic sequence
gcctttcctggcgt

SEQ ID NO: 5758 - DNA, 14 bp, Artificial sequence
  synthetic sequence
gtatcatcagatct

SEQ ID NO: 5759 - DNA, 14 bp, Artificial sequence
  synthetic sequence
tatcgttagaaaat

SEQ ID NO: 5760 - DNA, 14 bp, Artificial sequence
  synthetic sequence
tcgcttctgcaact

SEQ ID NO: 5761 - DNA, 14 bp, Artificial sequence
  synthetic sequence
tttatacagctagg

SEQ ID NO: 5762 - DNA, 14 bp, Artificial sequence
  synthetic sequence
tgcaaattagattg

SEQ ID NO: 5763 - DNA, 14 bp, Artificial sequence
  synthetic sequence
gcctctatattcca

SEQ ID NO: 5764 - DNA, 14 bp, Artificial sequence
  synthetic sequence
aagttcatcctctc

SEQ ID NO: 5765 - DNA, 14 bp, Artificial sequence
  synthetic sequence
ttgccaacctttgg

SEQ ID NO: 5766 - DNA, 14 bp, Artificial sequence
  synthetic sequence
gttttccggacctg

SEQ ID NO: 5767 - DNA, 14 bp, Artificial sequence
  synthetic sequence
tgaaaaattgtctc

SEQ ID NO: 5768 - DNA, 14 bp, Artificial sequence
  synthetic sequence
agtacatcattatg

SEQ ID NO: 5769 - DNA, 14 bp, Artificial sequence
  synthetic sequence
cgttatcaggtggt

SEQ ID NO: 5770 - DNA, 14 bp, Artificial sequence
  synthetic sequence
tggttcatagtacg

SEQ ID NO: 5771 - DNA, 14 bp, Artificial sequence
  synthetic sequence
cggggtttctacat

SEQ ID NO: 5772 - DNA, 14 bp, Artificial sequence
  synthetic sequence
taccaaggtttaat

SEQ ID NO: 5773 - DNA, 14 bp, Artificial sequence
  synthetic sequence
ccattacgtcctta

SEQ ID NO: 5774 - DNA, 14 bp, Artificial sequence
  synthetic sequence
ctgaatgttaaata

SEQ ID NO: 5775 - DNA, 14 bp, Artificial sequence
  synthetic sequence
ttgaattatgccca

SEQ ID NO: 5776 - DNA, 14 bp, Artificial sequence
  synthetic sequence
tttaggctgcacct

SEQ ID NO: 5777 - DNA, 14 bp, Artificial sequence
  synthetic sequence
tggtaaccctgtta

SEQ ID NO: 5778 - DNA, 14 bp, Artificial sequence
  synthetic sequence
atctctatgagtgc

SEQ ID NO: 5779 - DNA, 14 bp, Artificial sequence
  synthetic sequence
ccttcttgatcgag

SEQ ID NO: 5780 - DNA, 14 bp, Artificial sequence
  synthetic sequence
gcagaatattattc

SEQ ID NO: 5781 - DNA, 14 bp, Artificial sequence
  synthetic sequence
tggcagggatttct

SEQ ID NO: 5782 - DNA, 14 bp, Artificial sequence
  synthetic sequence
gctcctgtgtccta

SEQ ID NO: 5783 - DNA, 14 bp, Artificial sequence
  synthetic sequence
attcctgatggcct

SEQ ID NO: 5784 - DNA, 14 bp, Artificial sequence
  synthetic sequence
accccttattgaat

SEQ ID NO: 5785 - DNA, 14 bp, Artificial sequence
  synthetic sequence
tagacacgttttgg

SEQ ID NO: 5786 - DNA, 14 bp, Artificial sequence
  synthetic sequence
gtaatgatacttca

SEQ ID NO: 5787 - DNA, 14 bp, Artificial sequence
  synthetic sequence
cttacgtcctgtca

SEQ ID NO: 5788 - DNA, 14 bp, Artificial sequence
  synthetic sequence
gcctgtggtgatta

SEQ ID NO: 5789 - DNA, 14 bp, Artificial sequence
  synthetic sequence
tgtcatattgccag

SEQ ID NO: 5790 - DNA, 14 bp, Artificial sequence
  synthetic sequence
tgttctatccaagc

SEQ ID NO: 5791 - DNA, 14 bp, Artificial sequence
  synthetic sequence
tccccttatctaca

SEQ ID NO: 5792 - DNA, 14 bp, Artificial sequence
  synthetic sequence
cttctaggaggttc

SEQ ID NO: 5793 - DNA, 14 bp, Artificial sequence
  synthetic sequence
attcgcggtgggtt

SEQ ID NO: 5794 - DNA, 14 bp, Artificial sequence
  synthetic sequence
tacatgtggcctta

SEQ ID NO: 5795 - DNA, 14 bp, Artificial sequence
  synthetic sequence
tgacgtccctcttc

SEQ ID NO: 5796 - DNA, 14 bp, Artificial sequence
  synthetic sequence
gtaaccttaacctt

SEQ ID NO: 5797 - DNA, 14 bp, Artificial sequence
  synthetic sequence
actgatgtttcaac

SEQ ID NO: 5798 - DNA, 14 bp, Artificial sequence
  synthetic sequence
cattttcaggagtc

SEQ ID NO: 5799 - DNA, 14 bp, Artificial sequence
  synthetic sequence
atggtacgcatttc

SEQ ID NO: 5800 - DNA, 14 bp, Artificial sequence
  synthetic sequence
ctcgatgtgcttca

SEQ ID NO: 5801 - DNA, 14 bp, Artificial sequence
  synthetic sequence
cctctttacgcctc

SEQ ID NO: 5802 - DNA, 14 bp, Artificial sequence
  synthetic sequence
gttgtgcctactcg

SEQ ID NO: 5803 - DNA, 14 bp, Artificial sequence
  synthetic sequence
gtactcgtatatcg

SEQ ID NO: 5804 - DNA, 14 bp, Artificial sequence
  synthetic sequence
gaatatctagttag

SEQ ID NO: 5805 - DNA, 14 bp, Artificial sequence
  synthetic sequence
gggcactcgttgtt

SEQ ID NO: 5806 - DNA, 14 bp, Artificial sequence
  synthetic sequence
gtttattggagggg

SEQ ID NO: 5807 - DNA, 14 bp, Artificial sequence
  synthetic sequence
acctgttgacgttg

SEQ ID NO: 5808 - DNA, 14 bp, Artificial sequence
  synthetic sequence
cctgattagttcac

SEQ ID NO: 5809 - DNA, 14 bp, Artificial sequence
  synthetic sequence
agctctctctaagt

SEQ ID NO: 5810 - DNA, 14 bp, Artificial sequence
  synthetic sequence
ctggttcaatgaat

SEQ ID NO: 5811 - DNA, 14 bp, Artificial sequence
  synthetic sequence
ctacgtctatgtgc

SEQ ID NO: 5812 - DNA, 14 bp, Artificial sequence
  synthetic sequence
ctctgggttagcta

SEQ ID NO: 5813 - DNA, 14 bp, Artificial sequence
  synthetic sequence
tcgatagattccct

SEQ ID NO: 5814 - DNA, 14 bp, Artificial sequence
  synthetic sequence
ctatcgttcagtgc

SEQ ID NO: 5815 - DNA, 14 bp, Artificial sequence
  synthetic sequence
ggattgatgataat

SEQ ID NO: 5816 - DNA, 14 bp, Artificial sequence
  synthetic sequence
tactggagatatct

SEQ ID NO: 5817 - DNA, 14 bp, Artificial sequence
  synthetic sequence
ttagaccaatagtt

SEQ ID NO: 5818 - DNA, 14 bp, Artificial sequence
  synthetic sequence
ttgttagctcaggc

SEQ ID NO: 5819 - DNA, 14 bp, Artificial sequence
  synthetic sequence
ctttaatatcacac

SEQ ID NO: 5820 - DNA, 14 bp, Artificial sequence
  synthetic sequence
tcagctcgtactta

SEQ ID NO: 5821 - DNA, 14 bp, Artificial sequence
  synthetic sequence
ggtcttgcgtaata

SEQ ID NO: 5822 - DNA, 14 bp, Artificial sequence
  synthetic sequence
acagggatattttc

SEQ ID NO: 5823 - DNA, 14 bp, Artificial sequence
  synthetic sequence
ttgatgcgtagtgg

SEQ ID NO: 5824 - DNA, 14 bp, Artificial sequence
  synthetic sequence
gctttaacagtcta

SEQ ID NO: 5825 - DNA, 14 bp, Artificial sequence
  synthetic sequence
ggctatacctcctt

SEQ ID NO: 5826 - DNA, 14 bp, Artificial sequence
  synthetic sequence
cattgtcctccgtc

SEQ ID NO: 5827 - DNA, 14 bp, Artificial sequence
  synthetic sequence
ccttacgtgcttag

SEQ ID NO: 5828 - DNA, 14 bp, Artificial sequence
  synthetic sequence
gctttaaattcccc

SEQ ID NO: 5829 - DNA, 14 bp, Artificial sequence
  synthetic sequence
cctatgtcttgacg

SEQ ID NO: 5830 - DNA, 14 bp, Artificial sequence
  synthetic sequence
gcttttgggccctc

SEQ ID NO: 5831 - DNA, 14 bp, Artificial sequence
  synthetic sequence
gtgagctgtatcta

SEQ ID NO: 5832 - DNA, 14 bp, Artificial sequence
  synthetic sequence
tatggatgtatgca

SEQ ID NO: 5833 - DNA, 14 bp, Artificial sequence
  synthetic sequence
gatcttcccgtgta

SEQ ID NO: 5834 - DNA, 14 bp, Artificial sequence
  synthetic sequence
cgttctatggtcgc

SEQ ID NO: 5835 - DNA, 14 bp, Artificial sequence
  synthetic sequence
tgttggttgcggcc

SEQ ID NO: 5836 - DNA, 14 bp, Artificial sequence
  synthetic sequence
agtgtagagttcgt

SEQ ID NO: 5837 - DNA, 14 bp, Artificial sequence
  synthetic sequence
ttcagaagtaactt

SEQ ID NO: 5838 - DNA, 14 bp, Artificial sequence
  synthetic sequence
acgggtttgtactc

SEQ ID NO: 5839 - DNA, 14 bp, Artificial sequence
  synthetic sequence
tgaggttctctaac

SEQ ID NO: 5840 - DNA, 14 bp, Artificial sequence
  synthetic sequence
ctcctccgggtctt

SEQ ID NO: 5841 - DNA, 14 bp, Artificial sequence
  synthetic sequence
attttcaggtaagg

SEQ ID NO: 5842 - DNA, 14 bp, Artificial sequence
  synthetic sequence
ccccctatatcctt

SEQ ID NO: 5843 - DNA, 14 bp, Artificial sequence
  synthetic sequence
tgcgtgtgcgattc

SEQ ID NO: 5844 - DNA, 14 bp, Artificial sequence
  synthetic sequence
taatgcgtctgctc

SEQ ID NO: 5845 - DNA, 14 bp, Artificial sequence
  synthetic sequence
cctatcccatatgt

SEQ ID NO: 5846 - DNA, 14 bp, Artificial sequence
  synthetic sequence
tcaccattatcgta

SEQ ID NO: 5847 - DNA, 14 bp, Artificial sequence
  synthetic sequence
taggaagttgatta

SEQ ID NO: 5848 - DNA, 14 bp, Artificial sequence
  synthetic sequence
ttggcaggttacta

SEQ ID NO: 5849 - DNA, 14 bp, Artificial sequence
  synthetic sequence
attcattgctgggc

SEQ ID NO: 5850 - DNA, 14 bp, Artificial sequence
  synthetic sequence
tcggatcgttatga

SEQ ID NO: 5851 - DNA, 14 bp, Artificial sequence
  synthetic sequence
ttatgcgctaacgt

SEQ ID NO: 5852 - DNA, 14 bp, Artificial sequence
  synthetic sequence
tgtgttgaacgcgt

SEQ ID NO: 5853 - DNA, 14 bp, Artificial sequence
  synthetic sequence
aggcttatctgctg

SEQ ID NO: 5854 - DNA, 14 bp, Artificial sequence
  synthetic sequence
cgttccctagtgtc

SEQ ID NO: 5855 - DNA, 14 bp, Artificial sequence
  synthetic sequence
tgtggttataccac

SEQ ID NO: 5856 - DNA, 14 bp, Artificial sequence
  synthetic sequence
gccctctcatcttc

SEQ ID NO: 5857 - DNA, 14 bp, Artificial sequence
  synthetic sequence
ctgttaaatagtgc

SEQ ID NO: 5858 - DNA, 14 bp, Artificial sequence
  synthetic sequence
cgtcgtagttagta

SEQ ID NO: 5859 - DNA, 14 bp, Artificial sequence
  synthetic sequence
tgttgactaccctg

SEQ ID NO: 5860 - DNA, 14 bp, Artificial sequence
  synthetic sequence
cctagcttctctcc

SEQ ID NO: 5861 - DNA, 14 bp, Artificial sequence
  synthetic sequence
caatttgattcgac

SEQ ID NO: 5862 - DNA, 14 bp, Artificial sequence
  synthetic sequence
tgtgtgtatgagaa

SEQ ID NO: 5863 - DNA, 14 bp, Artificial sequence
  synthetic sequence
atctgtcctgccta

SEQ ID NO: 5864 - DNA, 14 bp, Artificial sequence
  synthetic sequence
tagaggtttgtcac

SEQ ID NO: 5865 - DNA, 14 bp, Artificial sequence
  synthetic sequence
atatgcgggtttcc

SEQ ID NO: 5866 - DNA, 14 bp, Artificial sequence
  synthetic sequence
caatattgcaatat

SEQ ID NO: 5867 - DNA, 14 bp, Artificial sequence
  synthetic sequence
gacacttactttca

SEQ ID NO: 5868 - DNA, 14 bp, Artificial sequence
  synthetic sequence
catcttaccattgc

SEQ ID NO: 5869 - DNA, 14 bp, Artificial sequence
  synthetic sequence
gagtttgaattcag

SEQ ID NO: 5870 - DNA, 14 bp, Artificial sequence
  synthetic sequence
ttcagatcgtcgta

SEQ ID NO: 5871 - DNA, 14 bp, Artificial sequence
  synthetic sequence
agcgccttctgttc

SEQ ID NO: 5872 - DNA, 14 bp, Artificial sequence
  synthetic sequence
acggtcttgactgt

SEQ ID NO: 5873 - DNA, 14 bp, Artificial sequence
  synthetic sequence
ggaagtctcgttgt

SEQ ID NO: 5874 - DNA, 14 bp, Artificial sequence
  synthetic sequence
ctgataggttcata

SEQ ID NO: 5875 - DNA, 14 bp, Artificial sequence
  synthetic sequence
catcgtattgtagc

SEQ ID NO: 5876 - DNA, 14 bp, Artificial sequence
  synthetic sequence
actgccttcggtgt

SEQ ID NO: 5877 - DNA, 14 bp, Artificial sequence
  synthetic sequence
ccattaagttatac

SEQ ID NO: 5878 - DNA, 14 bp, Artificial sequence
  synthetic sequence
gtgttcggcctctg

SEQ ID NO: 5879 - DNA, 14 bp, Artificial sequence
  synthetic sequence
ttgctgttacgcgg

SEQ ID NO: 5880 - DNA, 14 bp, Artificial sequence
  synthetic sequence
gtttcgtgtacagc

SEQ ID NO: 5881 - DNA, 14 bp, Artificial sequence
  synthetic sequence
gttcgctccctact

SEQ ID NO: 5882 - DNA, 14 bp, Artificial sequence
  synthetic sequence
aacatgttagattc

SEQ ID NO: 5883 - DNA, 14 bp, Artificial sequence
  synthetic sequence
ctcaccattatatg

SEQ ID NO: 5884 - DNA, 14 bp, Artificial sequence
  synthetic sequence
ttggattctaaacg

SEQ ID NO: 5885 - DNA, 14 bp, Artificial sequence
  synthetic sequence
tgaattgagtcggt

SEQ ID NO: 5886 - DNA, 14 bp, Artificial sequence
  synthetic sequence
cactctcttgaggt

SEQ ID NO: 5887 - DNA, 14 bp, Artificial sequence
  synthetic sequence
tcgttctatgcggg

SEQ ID NO: 5888 - DNA, 14 bp, Artificial sequence
  synthetic sequence
gcttccattcacct

SEQ ID NO: 5889 - DNA, 14 bp, Artificial sequence
  synthetic sequence
tgttactcgcccat

SEQ ID NO: 5890 - DNA, 14 bp, Artificial sequence
  synthetic sequence
tgatcatatggcct

SEQ ID NO: 5891 - DNA, 14 bp, Artificial sequence
  synthetic sequence
agttcgtcctacat

SEQ ID NO: 5892 - DNA, 14 bp, Artificial sequence
  synthetic sequence
gtagaagtttatag

SEQ ID NO: 5893 - DNA, 14 bp, Artificial sequence
  synthetic sequence
ttggtactagaaat

SEQ ID NO: 5894 - DNA, 14 bp, Artificial sequence
  synthetic sequence
tagttcataatggc

SEQ ID NO: 5895 - DNA, 14 bp, Artificial sequence
  synthetic sequence
tagctgatctgtcc

SEQ ID NO: 5896 - DNA, 14 bp, Artificial sequence
  synthetic sequence
cagtgtcggccttt

SEQ ID NO: 5897 - DNA, 14 bp, Artificial sequence
  synthetic sequence
tcttgggcacggtt

SEQ ID NO: 5898 - DNA, 14 bp, Artificial sequence
  synthetic sequence
agacttgcttactg

SEQ ID NO: 5899 - DNA, 14 bp, Artificial sequence
  synthetic sequence
ggtatgaaaacttt

SEQ ID NO: 5900 - DNA, 14 bp, Artificial sequence
  synthetic sequence
gtcttgaccgtaat

SEQ ID NO: 5901 - DNA, 14 bp, Artificial sequence
  synthetic sequence
aatcttgatgacta

SEQ ID NO: 5902 - DNA, 14 bp, Artificial sequence
  synthetic sequence
atcgcagtttatcc

SEQ ID NO: 5903 - DNA, 14 bp, Artificial sequence
  synthetic sequence
ccatattgaattcg

SEQ ID NO: 5904 - DNA, 14 bp, Artificial sequence
  synthetic sequence
tgcttatacatcaa

SEQ ID NO: 5905 - DNA, 14 bp, Artificial sequence
  synthetic sequence
catgtgactttcag

SEQ ID NO: 5906 - DNA, 14 bp, Artificial sequence
  synthetic sequence
attgagaagtcatt

SEQ ID NO: 5907 - DNA, 14 bp, Artificial sequence
  synthetic sequence
aatccggatttgct

SEQ ID NO: 5908 - DNA, 14 bp, Artificial sequence
  synthetic sequence
tctgtcctgacgtg

SEQ ID NO: 5909 - DNA, 14 bp, Artificial sequence
  synthetic sequence
atgtgcaattgagt

SEQ ID NO: 5910 - DNA, 14 bp, Artificial sequence
  synthetic sequence
aagatgtgccgttt

SEQ ID NO: 5911 - DNA, 14 bp, Artificial sequence
  synthetic sequence
agagttgcttctac

SEQ ID NO: 5912 - DNA, 14 bp, Artificial sequence
  synthetic sequence
atgcttatatccac

SEQ ID NO: 5913 - DNA, 14 bp, Artificial sequence
  synthetic sequence
atcatactagtatc

SEQ ID NO: 5914 - DNA, 14 bp, Artificial sequence
  synthetic sequence
ggttctgaggttac

SEQ ID NO: 5915 - DNA, 14 bp, Artificial sequence
  synthetic sequence
gtgtaattcgccat

SEQ ID NO: 5916 - DNA, 14 bp, Artificial sequence
  synthetic sequence
cgttcagaggcttt

SEQ ID NO: 5917 - DNA, 14 bp, Artificial sequence
  synthetic sequence
tcgtactataaagt

SEQ ID NO: 5918 - DNA, 14 bp, Artificial sequence
  synthetic sequence
tttgcatcctagaa

SEQ ID NO: 5919 - DNA, 14 bp, Artificial sequence
  synthetic sequence
cggtttacgttaga

SEQ ID NO: 5920 - DNA, 14 bp, Artificial sequence
  synthetic sequence
tccgtaagattcat

SEQ ID NO: 5921 - DNA, 14 bp, Artificial sequence
  synthetic sequence
gcgatactttctcc

SEQ ID NO: 5922 - DNA, 14 bp, Artificial sequence
  synthetic sequence
caaacttggtttac

SEQ ID NO: 5923 - DNA, 14 bp, Artificial sequence
  synthetic sequence
tgttgcagattgca

SEQ ID NO: 5924 - DNA, 14 bp, Artificial sequence
  synthetic sequence
cggtttgatctcgc

SEQ ID NO: 5925 - DNA, 14 bp, Artificial sequence
  synthetic sequence
aactcgtaggattt

SEQ ID NO: 5926 - DNA, 14 bp, Artificial sequence
  synthetic sequence
aattgctctaggtg

SEQ ID NO: 5927 - DNA, 14 bp, Artificial sequence
  synthetic sequence
tcatcatttggaag

SEQ ID NO: 5928 - DNA, 14 bp, Artificial sequence
  synthetic sequence
ttgcgcttatccca

SEQ ID NO: 5929 - DNA, 14 bp, Artificial sequence
  synthetic sequence
aatgtattctgaag

SEQ ID NO: 5930 - DNA, 14 bp, Artificial sequence
  synthetic sequence
acaattcttcttgc

SEQ ID NO: 5931 - DNA, 14 bp, Artificial sequence
  synthetic sequence
agctgaatatttta

SEQ ID NO: 5932 - DNA, 14 bp, Artificial sequence
  synthetic sequence
ctatgtttctccag

SEQ ID NO: 5933 - DNA, 14 bp, Artificial sequence
  synthetic sequence
gcctttctctctaa

SEQ ID NO: 5934 - DNA, 14 bp, Artificial sequence
  synthetic sequence
tctctttcgactaa

SEQ ID NO: 5935 - DNA, 14 bp, Artificial sequence
  synthetic sequence
gatttatcgctctg

SEQ ID NO: 5936 - DNA, 14 bp, Artificial sequence
  synthetic sequence
tatcttaatgctgc

SEQ ID NO: 5937 - DNA, 14 bp, Artificial sequence
  synthetic sequence
ggtacttggtcttg

SEQ ID NO: 5938 - DNA, 14 bp, Artificial sequence
  synthetic sequence
tatctgtacagtgt

SEQ ID NO: 5939 - DNA, 14 bp, Artificial sequence
  synthetic sequence
tagtttgaactgct

SEQ ID NO: 5940 - DNA, 14 bp, Artificial sequence
  synthetic sequence
ttaaccttgttcga

SEQ ID NO: 5941 - DNA, 14 bp, Artificial sequence
  synthetic sequence
cactgtacttgctt

SEQ ID NO: 5942 - DNA, 14 bp, Artificial sequence
  synthetic sequence
cgtgtataatttgg

SEQ ID NO: 5943 - DNA, 14 bp, Artificial sequence
  synthetic sequence
atgtaactctttcc

SEQ ID NO: 5944 - DNA, 14 bp, Artificial sequence
  synthetic sequence
atggtctgtcatgt

SEQ ID NO: 5945 - DNA, 14 bp, Artificial sequence
  synthetic sequence
gttaggttgatgat

SEQ ID NO: 5946 - DNA, 14 bp, Artificial sequence
  synthetic sequence
tagtttagttcggg

SEQ ID NO: 5947 - DNA, 14 bp, Artificial sequence
  synthetic sequence
tgtgttacaactat

SEQ ID NO: 5948 - DNA, 14 bp, Artificial sequence
  synthetic sequence
tgtgaggatttatc

SEQ ID NO: 5949 - DNA, 14 bp, Artificial sequence
  synthetic sequence
tttcgctaaaattc

SEQ ID NO: 5950 - DNA, 14 bp, Artificial sequence
  synthetic sequence
cataagttgttgtg

SEQ ID NO: 5951 - DNA, 14 bp, Artificial sequence
  synthetic sequence
cttattggcatatc

SEQ ID NO: 5952 - DNA, 14 bp, Artificial sequence
  synthetic sequence
tcgtcttatggata

SEQ ID NO: 5953 - DNA, 14 bp, Artificial sequence
  synthetic sequence
tagaagtactcttt

SEQ ID NO: 5954 - DNA, 14 bp, Artificial sequence
  synthetic sequence
ctgtttccacatta

SEQ ID NO: 5955 - DNA, 14 bp, Artificial sequence
  synthetic sequence
ttgatagactgttg

SEQ ID NO: 5956 - DNA, 14 bp, Artificial sequence
  synthetic sequence
ctaatgttttggag

SEQ ID NO: 5957 - DNA, 14 bp, Artificial sequence
  synthetic sequence
ctagctatttaatg

SEQ ID NO: 5958 - DNA, 14 bp, Artificial sequence
  synthetic sequence
gggctttttaggtg

SEQ ID NO: 5959 - DNA, 14 bp, Artificial sequence
  synthetic sequence
gggtttactgtctg

SEQ ID NO: 5960 - DNA, 14 bp, Artificial sequence
  synthetic sequence
atctctcattctcc

SEQ ID NO: 5961 - DNA, 14 bp, Artificial sequence
  synthetic sequence
tgtttacaccatgt

SEQ ID NO: 5962 - DNA, 14 bp, Artificial sequence
  synthetic sequence
ctctcttaagcttc

SEQ ID NO: 5963 - DNA, 14 bp, Artificial sequence
  synthetic sequence
cacgatgtttattg

SEQ ID NO: 5964 - DNA, 14 bp, Artificial sequence
  synthetic sequence
tatctgcgtggtat

SEQ ID NO: 5965 - DNA, 14 bp, Artificial sequence
  synthetic sequence
tttagtatcgaatg

SEQ ID NO: 5966 - DNA, 14 bp, Artificial sequence
  synthetic sequence
tgatgatcactctt

SEQ ID NO: 5967 - DNA, 14 bp, Artificial sequence
  synthetic sequence
tcttgaggtgcttc

SEQ ID NO: 5968 - DNA, 14 bp, Artificial sequence
  synthetic sequence
aatttggcaattat

SEQ ID NO: 5969 - DNA, 14 bp, Artificial sequence
  synthetic sequence
ggcttattcagctt

SEQ ID NO: 5970 - DNA, 14 bp, Artificial sequence
  synthetic sequence
ggtatgctctgtat

SEQ ID NO: 5971 - DNA, 14 bp, Artificial sequence
  synthetic sequence
tttaagggctttca

SEQ ID NO: 5972 - DNA, 14 bp, Artificial sequence
  synthetic sequence
caacatggttgttt

SEQ ID NO: 5973 - DNA, 14 bp, Artificial sequence
  synthetic sequence
tttatgtagagaat

SEQ ID NO: 5974 - DNA, 14 bp, Artificial sequence
  synthetic sequence
gtgaatgttcatct

SEQ ID NO: 5975 - DNA, 14 bp, Artificial sequence
  synthetic sequence
ttaagtccgtttcc

SEQ ID NO: 5976 - DNA, 14 bp, Artificial sequence
  synthetic sequence
ttttgccgtgcagt

SEQ ID NO: 5977 - DNA, 14 bp, Artificial sequence
  synthetic sequence
atttctgtccaata

SEQ ID NO: 5978 - DNA, 14 bp, Artificial sequence
  synthetic sequence
tgaattttacgtgg

SEQ ID NO: 5979 - DNA, 14 bp, Artificial sequence
  synthetic sequence
ggttaacttggatt

SEQ ID NO: 5980 - DNA, 14 bp, Artificial sequence
  synthetic sequence
tccatatgttatgc

SEQ ID NO: 5981 - DNA, 14 bp, Artificial sequence
  synthetic sequence
tacatatttctcaa

SEQ ID NO: 5982 - DNA, 14 bp, Artificial sequence
  synthetic sequence
cttagggcatattt

SEQ ID NO: 5983 - DNA, 14 bp, Artificial sequence
  synthetic sequence
cccattgtttccgt

SEQ ID NO: 5984 - DNA, 14 bp, Artificial sequence
  synthetic sequence
ttgttggccttcga

SEQ ID NO: 5985 - DNA, 14 bp, Artificial sequence
  synthetic sequence
tgtctgcacctctt

SEQ ID NO: 5986 - DNA, 14 bp, Artificial sequence
  synthetic sequence
ttacttgtatagac

SEQ ID NO: 5987 - DNA, 14 bp, Artificial sequence
  synthetic sequence
cctagaaatttatt

SEQ ID NO: 5988 - DNA, 14 bp, Artificial sequence
  synthetic sequence
cttgatctattaag

SEQ ID NO: 5989 - DNA, 14 bp, Artificial sequence
  synthetic sequence
atttttcgtgggac

SEQ ID NO: 5990 - DNA, 14 bp, Artificial sequence
  synthetic sequence
caatcctgctttct

SEQ ID NO: 5991 - DNA, 14 bp, Artificial sequence
  synthetic sequence
cttcattgtagata

SEQ ID NO: 5992 - DNA, 14 bp, Artificial sequence
  synthetic sequence
tggcttcaatctta

SEQ ID NO: 5993 - DNA, 14 bp, Artificial sequence
  synthetic sequence
attggtaattctgg

SEQ ID NO: 5994 - DNA, 14 bp, Artificial sequence
  synthetic sequence
ctgttccttatacc

SEQ ID NO: 5995 - DNA, 14 bp, Artificial sequence
  synthetic sequence
cactctcttcttcc

SEQ ID NO: 5996 - DNA, 14 bp, Artificial sequence
  synthetic sequence
aattctttctgcac

SEQ ID NO: 5997 - DNA, 14 bp, Artificial sequence
  synthetic sequence
aattaccactttgt

SEQ ID NO: 5998 - DNA, 14 bp, Artificial sequence
  synthetic sequence
ctatttccctgtac

SEQ ID NO: 5999 - DNA, 14 bp, Artificial sequence
  synthetic sequence
ttgtacgtggattg

SEQ ID NO: 6000 - DNA, 14 bp, Artificial sequence
  synthetic sequence
cccgaacttttatt

SEQ ID NO: 6001 - DNA, 14 bp, Artificial sequence
  synthetic sequence
ctttccaattaact

SEQ ID NO: 6002 - DNA, 14 bp, Artificial sequence
  synthetic sequence
ttcgcttcgtactc

SEQ ID NO: 6003 - DNA, 14 bp, Artificial sequence
  synthetic sequence
cttgtttgtgaaag

SEQ ID NO: 6004 - DNA, 14 bp, Artificial sequence
  synthetic sequence
ctctctccttcagt

SEQ ID NO: 6005 - DNA, 14 bp, Artificial sequence
  synthetic sequence
gcttcgtcgttgtc

SEQ ID NO: 6006 - DNA, 14 bp, Artificial sequence
  synthetic sequence
ggatctaagctttt

SEQ ID NO: 6007 - DNA, 14 bp, Artificial sequence
  synthetic sequence
tgatatagttgtac

SEQ ID NO: 6008 - DNA, 14 bp, Artificial sequence
  synthetic sequence
cttaccgtgtactt

SEQ ID NO: 6009 - DNA, 14 bp, Artificial sequence
  synthetic sequence
tcattaaatgctat

SEQ ID NO: 6010 - DNA, 14 bp, Artificial sequence
  synthetic sequence
tgtttgccagtaat

SEQ ID NO: 6011 - DNA, 14 bp, Artificial sequence
  synthetic sequence
atctttatgatgag

SEQ ID NO: 6012 - DNA, 14 bp, Artificial sequence
  synthetic sequence
acctctttcctcat

SEQ ID NO: 6013 - DNA, 14 bp, Artificial sequence
  synthetic sequence
cttatttctagagc

SEQ ID NO: 6014 - DNA, 14 bp, Artificial sequence
  synthetic sequence
tgttggtactaagt

SEQ ID NO: 6015 - DNA, 14 bp, Artificial sequence
  synthetic sequence
tccgttatagttag

SEQ ID NO: 6016 - DNA, 14 bp, Artificial sequence
  synthetic sequence
aaacttgatgttat

SEQ ID NO: 6017 - DNA, 14 bp, Artificial sequence
  synthetic sequence
attcgtgaatttca

SEQ ID NO: 6018 - DNA, 14 bp, Artificial sequence
  synthetic sequence
ttgctagttataag

SEQ ID NO: 6019 - DNA, 14 bp, Artificial sequence
  synthetic sequence
ttgtcctataatca

SEQ ID NO: 6020 - DNA, 14 bp, Artificial sequence
  synthetic sequence
gggctcgtttactt

SEQ ID NO: 6021 - DNA, 14 bp, Artificial sequence
  synthetic sequence
ttattgaagcgatt

SEQ ID NO: 6022 - DNA, 14 bp, Artificial sequence
  synthetic sequence
ttggagtatactgt

SEQ ID NO: 6023 - DNA, 14 bp, Artificial sequence
  synthetic sequence
aagttactatcttg

SEQ ID NO: 6024 - DNA, 14 bp, Artificial sequence
  synthetic sequence
gctgacgtcttttc

SEQ ID NO: 6025 - DNA, 14 bp, Artificial sequence
  synthetic sequence
ttgtgtctaaccat

SEQ ID NO: 6026 - DNA, 14 bp, Artificial sequence
  synthetic sequence
gtgttctgatgtcg

SEQ ID NO: 6027 - DNA, 14 bp, Artificial sequence
  synthetic sequence
ccttctaaatctta

SEQ ID NO: 6028 - DNA, 14 bp, Artificial sequence
  synthetic sequence
gtgatttaatactc

SEQ ID NO: 6029 - DNA, 14 bp, Artificial sequence
  synthetic sequence
atggctagttgatt

SEQ ID NO: 6030 - DNA, 14 bp, Artificial sequence
  synthetic sequence
aaggctctttatgt

SEQ ID NO: 6031 - DNA, 14 bp, Artificial sequence
  synthetic sequence
atcttttacgggat

SEQ ID NO: 6032 - DNA, 14 bp, Artificial sequence
  synthetic sequence
ctgtgtaattgtcg

SEQ ID NO: 6033 - DNA, 14 bp, Artificial sequence
  synthetic sequence
taattaagtacctt

SEQ ID NO: 6034 - DNA, 14 bp, Artificial sequence
  synthetic sequence
aagtttgattctca

SEQ ID NO: 6035 - DNA, 14 bp, Artificial sequence
  synthetic sequence
gatgttttctggca

SEQ ID NO: 6036 - DNA, 14 bp, Artificial sequence
  synthetic sequence
tagttcatctatga

SEQ ID NO: 6037 - DNA, 14 bp, Artificial sequence
  synthetic sequence
aggtatgtttcctc

SEQ ID NO: 6038 - DNA, 14 bp, Artificial sequence
  synthetic sequence
tcttgctggcgttc

SEQ ID NO: 6039 - DNA, 14 bp, Artificial sequence
  synthetic sequence
acttgttattgcgc

SEQ ID NO: 6040 - DNA, 14 bp, Artificial sequence
  synthetic sequence
ccttggcacgtttt

SEQ ID NO: 6041 - DNA, 14 bp, Artificial sequence
  synthetic sequence
agttgtgattacat

SEQ ID NO: 6042 - DNA, 14 bp, Artificial sequence
  synthetic sequence
tgtaattgcattac

SEQ ID NO: 6043 - DNA, 14 bp, Artificial sequence
  synthetic sequence
ccttttgctaggtg

SEQ ID NO: 6044 - DNA, 14 bp, Artificial sequence
  synthetic sequence
acagctctctgttt

SEQ ID NO: 6045 - DNA, 14 bp, Artificial sequence
  synthetic sequence
gtctttggtgaggt

SEQ ID NO: 6046 - DNA, 14 bp, Artificial sequence
  synthetic sequence
acgcatatatattt

SEQ ID NO: 6047 - DNA, 14 bp, Artificial sequence
  synthetic sequence
gcgattttattgga

SEQ ID NO: 6048 - DNA, 14 bp, Artificial sequence
  synthetic sequence
ttgctacttccata

SEQ ID NO: 6049 - DNA, 14 bp, Artificial sequence
  synthetic sequence
tacgtggtcattta

SEQ ID NO: 6050 - DNA, 14 bp, Artificial sequence
  synthetic sequence
gtactttacatact

SEQ ID NO: 6051 - DNA, 14 bp, Artificial sequence
  synthetic sequence
agcattgatttata

SEQ ID NO: 6052 - DNA, 14 bp, Artificial sequence
  synthetic sequence
ttcgttggcgtata

SEQ ID NO: 6053 - DNA, 14 bp, Artificial sequence
  synthetic sequence
tgttcattacacct

SEQ ID NO: 6054 - DNA, 14 bp, Artificial sequence
  synthetic sequence
cctttagattatga

SEQ ID NO: 6055 - DNA, 14 bp, Artificial sequence
  synthetic sequence
ttttcgatcgctcg

SEQ ID NO: 6056 - DNA, 14 bp, Artificial sequence
  synthetic sequence
attgagcccttttc

SEQ ID NO: 6057 - DNA, 14 bp, Artificial sequence
  synthetic sequence
acattctttcacta

SEQ ID NO: 6058 - DNA, 14 bp, Artificial sequence
  synthetic sequence
gttgtcctcctggt

SEQ ID NO: 6059 - DNA, 14 bp, Artificial sequence
  synthetic sequence
gtatttgttaccgg

SEQ ID NO: 6060 - DNA, 14 bp, Artificial sequence
  synthetic sequence
tgtaaggtttccat

SEQ ID NO: 6061 - DNA, 14 bp, Artificial sequence
  synthetic sequence
tcctcatgttagtt

SEQ ID NO: 6062 - DNA, 14 bp, Artificial sequence
  synthetic sequence
gtgtgtgattttgc

SEQ ID NO: 6063 - DNA, 14 bp, Artificial sequence
  synthetic sequence
tttttggtgaccat

SEQ ID NO: 6064 - DNA, 14 bp, Artificial sequence
  synthetic sequence
cttgcagtctttat

SEQ ID NO: 6065 - DNA, 14 bp, Artificial sequence
  synthetic sequence
tatacctttttgaa

SEQ ID NO: 6066 - DNA, 14 bp, Artificial sequence
  synthetic sequence
ggttttatctcgtc

SEQ ID NO: 6067 - DNA, 14 bp, Artificial sequence
  synthetic sequence
tttccgtattactc

SEQ ID NO: 6068 - DNA, 14 bp, Artificial sequence
  synthetic sequence
atttcctcgttcgt

SEQ ID NO: 6069 - DNA, 14 bp, Artificial sequence
  synthetic sequence
tttaggtattctcc

SEQ ID NO: 6070 - DNA, 14 bp, Artificial sequence
  synthetic sequence
ttagctccttcctt

SEQ ID NO: 6071 - DNA, 14 bp, Artificial sequence
  synthetic sequence
aacgttttcaattt

SEQ ID NO: 6072 - DNA, 14 bp, Artificial sequence
  synthetic sequence
gcctatttagcttt

SEQ ID NO: 6073 - DNA, 14 bp, Artificial sequence
  synthetic sequence
catttgctgctttc

SEQ ID NO: 6074 - DNA, 14 bp, Artificial sequence
  synthetic sequence
tcatctttcgaatt

SEQ ID NO: 6075 - DNA, 14 bp, Artificial sequence
  synthetic sequence
tatgtcttcatact

SEQ ID NO: 6076 - DNA, 14 bp, Artificial sequence
  synthetic sequence
cttatctagttcat

SEQ ID NO: 6077 - DNA, 14 bp, Artificial sequence
  synthetic sequence
taagttctttgatc

SEQ ID NO: 6078 - DNA, 14 bp, Artificial sequence
  synthetic sequence
gttgtttggtgcta

SEQ ID NO: 6079 - DNA, 14 bp, Artificial sequence
  synthetic sequence
cgtatcatactttt

SEQ ID NO: 6080 - DNA, 14 bp, Artificial sequence
  synthetic sequence
tttgcgttcctcgt

SEQ ID NO: 6081 - DNA, 14 bp, Artificial sequence
  synthetic sequence
ttgctgaattctat

SEQ ID NO: 6082 - DNA, 14 bp, Artificial sequence
  synthetic sequence
atgttttaacgttc

SEQ ID NO: 6083 - DNA, 14 bp, Artificial sequence
  synthetic sequence
gctctactattatt

SEQ ID NO: 6084 - DNA, 14 bp, Artificial sequence
  synthetic sequence
atactttttggtca

SEQ ID NO: 6085 - DNA, 14 bp, Artificial sequence
  synthetic sequence
ctctttttcgcgtg

SEQ ID NO: 6086 - DNA, 14 bp, Artificial sequence
  synthetic sequence
gctatattttgtag

SEQ ID NO: 6087 - DNA, 14 bp, Artificial sequence
  synthetic sequence
gagtgcttattttc

SEQ ID NO: 6088 - DNA, 14 bp, Artificial sequence
  synthetic sequence
catttgatttactc

SEQ ID NO: 6089 - DNA, 14 bp, Artificial sequence
  synthetic sequence
tgtgtcagattttc

SEQ ID NO: 6090 - DNA, 14 bp, Artificial sequence
  synthetic sequence
tgtgttcgtttgca

SEQ ID NO: 6091 - DNA, 14 bp, Artificial sequence
  synthetic sequence
tcttatcgaattta

SEQ ID NO: 6092 - DNA, 14 bp, Artificial sequence
  synthetic sequence
tgatatttttcgaa

SEQ ID NO: 6093 - DNA, 14 bp, Artificial sequence
  synthetic sequence
gaactgtttgtctt

SEQ ID NO: 6094 - DNA, 14 bp, Artificial sequence
  synthetic sequence
ttttgtagaatgtc

SEQ ID NO: 6095 - DNA, 14 bp, Artificial sequence
  synthetic sequence
tgggattttcttcg

SEQ ID NO: 6096 - DNA, 14 bp, Artificial sequence
  synthetic sequence
gtatattgttgctg

SEQ ID NO: 6097 - DNA, 14 bp, Artificial sequence
  synthetic sequence
tgctttctaattac

SEQ ID NO: 6098 - DNA, 14 bp, Artificial sequence
  synthetic sequence
taccatttatagtt

SEQ ID NO: 6099 - DNA, 14 bp, Artificial sequence
  synthetic sequence
gtggttctatgttg

SEQ ID NO: 6100 - DNA, 14 bp, Artificial sequence
  synthetic sequence
cttttcttgtccgc

SEQ ID NO: 6101 - DNA, 14 bp, Artificial sequence
  synthetic sequence
atagatgctttatt

SEQ ID NO: 6102 - DNA, 14 bp, Artificial sequence
  synthetic sequence
tgttttacgttgag

SEQ ID NO: 6103 - DNA, 14 bp, Artificial sequence
  synthetic sequence
tagtccttgtttgg

SEQ ID NO: 6104 - DNA, 14 bp, Artificial sequence
  synthetic sequence
tttttggtattctg

SEQ ID NO: 6105 - DNA, 14 bp, Artificial sequence
  synthetic sequence
tatttttcgtgttt

SEQ ID NO: 6106 - DNA, 14 bp, Artificial sequence
  synthetic sequence
gtttcgttattttt

SEQ ID NO: 6107 - DNA, 14 bp, Artificial sequence
  synthetic sequence
agctgtgcgcaaga

SEQ ID NO: 6108 - DNA, 14 bp, Artificial sequence
  synthetic sequence
ggcggaacctcatg

SEQ ID NO: 6109 - DNA, 14 bp, Artificial sequence
  synthetic sequence
gagtagggtgaggc

SEQ ID NO: 6110 - DNA, 14 bp, Artificial sequence
  synthetic sequence
accgtgacggcagt

SEQ ID NO: 6111 - DNA, 14 bp, Artificial sequence
  synthetic sequence
cccacagcaaaatt

SEQ ID NO: 6112 - DNA, 14 bp, Artificial sequence
  synthetic sequence
accgaaatcctcac

SEQ ID NO: 6113 - DNA, 14 bp, Artificial sequence
  synthetic sequence
agaccaagggagtt

SEQ ID NO: 6114 - DNA, 14 bp, Artificial sequence
  synthetic sequence
taaaggccgaatgg

SEQ ID NO: 6115 - DNA, 14 bp, Artificial sequence
  synthetic sequence
caccccgttggaaa

SEQ ID NO: 6116 - DNA, 14 bp, Artificial sequence
  synthetic sequence
gtagccccacaaat

SEQ ID NO: 6117 - DNA, 14 bp, Artificial sequence
  synthetic sequence
tgagggcgtaacac

SEQ ID NO: 6118 - DNA, 14 bp, Artificial sequence
  synthetic sequence
agggacgctgcgtg

SEQ ID NO: 6119 - DNA, 14 bp, Artificial sequence
  synthetic sequence
accaactgacgctc

SEQ ID NO: 6120 - DNA, 14 bp, Artificial sequence
  synthetic sequence
gcaatcacgcgtaa

SEQ ID NO: 6121 - DNA, 14 bp, Artificial sequence
  synthetic sequence
tctccggacgcacc

SEQ ID NO: 6122 - DNA, 14 bp, Artificial sequence
  synthetic sequence
cgggtcgcctgaaa

SEQ ID NO: 6123 - DNA, 14 bp, Artificial sequence
  synthetic sequence
gaaaaagtaggatg

SEQ ID NO: 6124 - DNA, 14 bp, Artificial sequence
  synthetic sequence
gaggcggtcataaa

SEQ ID NO: 6125 - DNA, 14 bp, Artificial sequence
  synthetic sequence
gtggtagcgcgcga

SEQ ID NO: 6126 - DNA, 14 bp, Artificial sequence
  synthetic sequence
aattccacacaaga

SEQ ID NO: 6127 - DNA, 14 bp, Artificial sequence
  synthetic sequence
caacggcgtggagt

SEQ ID NO: 6128 - DNA, 14 bp, Artificial sequence
  synthetic sequence
acgggtcatgggac

SEQ ID NO: 6129 - DNA, 14 bp, Artificial sequence
  synthetic sequence
ggacctggacacgt

SEQ ID NO: 6130 - DNA, 14 bp, Artificial sequence
  synthetic sequence
gaaaaatacggtcg

SEQ ID NO: 6131 - DNA, 14 bp, Artificial sequence
  synthetic sequence
cgcaggacattccc

SEQ ID NO: 6132 - DNA, 14 bp, Artificial sequence
  synthetic sequence
gttaccgcagggcg

SEQ ID NO: 6133 - DNA, 14 bp, Artificial sequence
  synthetic sequence
gacaagcccgttga

SEQ ID NO: 6134 - DNA, 14 bp, Artificial sequence
  synthetic sequence
tgcgtggcgacgac

SEQ ID NO: 6135 - DNA, 14 bp, Artificial sequence
  synthetic sequence
atcagaacataaga

SEQ ID NO: 6136 - DNA, 14 bp, Artificial sequence
  synthetic sequence
acaagccgcatgtc

SEQ ID NO: 6137 - DNA, 14 bp, Artificial sequence
  synthetic sequence
tagaggcgggcctc

SEQ ID NO: 6138 - DNA, 14 bp, Artificial sequence
  synthetic sequence
catagaagccgtaa

SEQ ID NO: 6139 - DNA, 14 bp, Artificial sequence
  synthetic sequence
ccgtaggacaagtg

SEQ ID NO: 6140 - DNA, 14 bp, Artificial sequence
  synthetic sequence
tgagacgcgagcat

SEQ ID NO: 6141 - DNA, 14 bp, Artificial sequence
  synthetic sequence
ccacacaaatctag

SEQ ID NO: 6142 - DNA, 14 bp, Artificial sequence
  synthetic sequence
acgccgtccagctg

SEQ ID NO: 6143 - DNA, 14 bp, Artificial sequence
  synthetic sequence
agagggaccttcac

SEQ ID NO: 6144 - DNA, 14 bp, Artificial sequence
  synthetic sequence
ctaggcatagccag

SEQ ID NO: 6145 - DNA, 14 bp, Artificial sequence
  synthetic sequence
gagcacgtccatcc

SEQ ID NO: 6146 - DNA, 14 bp, Artificial sequence
  synthetic sequence
acaaattcagcgac

SEQ ID NO: 6147 - DNA, 14 bp, Artificial sequence
  synthetic sequence
agaacatgggtccg

SEQ ID NO: 6148 - DNA, 14 bp, Artificial sequence
  synthetic sequence
cgcgatgccgcact

SEQ ID NO: 6149 - DNA, 14 bp, Artificial sequence
  synthetic sequence
gcggagtgtaacaa

SEQ ID NO: 6150 - DNA, 14 bp, Artificial sequence
  synthetic sequence
gaagctgtagggcg

SEQ ID NO: 6151 - DNA, 14 bp, Artificial sequence
  synthetic sequence
ccggactcgaccta

SEQ ID NO: 6152 - DNA, 14 bp, Artificial sequence
  synthetic sequence
cctccgacggtgag

SEQ ID NO: 6153 - DNA, 14 bp, Artificial sequence
  synthetic sequence
aaggacaacaatat

SEQ ID NO: 6154 - DNA, 14 bp, Artificial sequence
  synthetic sequence
gagcagagtcgcgt

SEQ ID NO: 6155 - DNA, 14 bp, Artificial sequence
  synthetic sequence
tgaccgcagcacct

SEQ ID NO: 6156 - DNA, 14 bp, Artificial sequence
  synthetic sequence
ggcgaccgacctat

SEQ ID NO: 6157 - DNA, 14 bp, Artificial sequence
  synthetic sequence
tcaggccagacagt

SEQ ID NO: 6158 - DNA, 14 bp, Artificial sequence
  synthetic sequence
agaatccgcagtga

SEQ ID NO: 6159 - DNA, 14 bp, Artificial sequence
  synthetic sequence
gacagaatggcaat

SEQ ID NO: 6160 - DNA, 14 bp, Artificial sequence
  synthetic sequence
actgaactgaggac

SEQ ID NO: 6161 - DNA, 14 bp, Artificial sequence
  synthetic sequence
agaaagggacgtat

SEQ ID NO: 6162 - DNA, 14 bp, Artificial sequence
  synthetic sequence
catccgcagcgtaa

SEQ ID NO: 6163 - DNA, 14 bp, Artificial sequence
  synthetic sequence
cctagtgacggccg

SEQ ID NO: 6164 - DNA, 14 bp, Artificial sequence
  synthetic sequence
atagccatagagca

SEQ ID NO: 6165 - DNA, 14 bp, Artificial sequence
  synthetic sequence
agccgtgaacgtcg

SEQ ID NO: 6166 - DNA, 14 bp, Artificial sequence
  synthetic sequence
aacagaaatcagtc

SEQ ID NO: 6167 - DNA, 14 bp, Artificial sequence
  synthetic sequence
tacaaaggctagca

SEQ ID NO: 6168 - DNA, 14 bp, Artificial sequence
  synthetic sequence
cgatgcgaccaact

SEQ ID NO: 6169 - DNA, 14 bp, Artificial sequence
  synthetic sequence
aggccgactcatac

SEQ ID NO: 6170 - DNA, 14 bp, Artificial sequence
  synthetic sequence
ctgcggcaccgtgg

SEQ ID NO: 6171 - DNA, 14 bp, Artificial sequence
  synthetic sequence
aaataaatcgggat

SEQ ID NO: 6172 - DNA, 14 bp, Artificial sequence
  synthetic sequence
atatggtgagcaac

SEQ ID NO: 6173 - DNA, 14 bp, Artificial sequence
  synthetic sequence
atgccagaacatat

SEQ ID NO: 6174 - DNA, 14 bp, Artificial sequence
  synthetic sequence
tcaaagtaacataa

SEQ ID NO: 6175 - DNA, 14 bp, Artificial sequence
  synthetic sequence
gggcaagctctgtg

SEQ ID NO: 6176 - DNA, 14 bp, Artificial sequence
  synthetic sequence
gaaggggcttcctc

SEQ ID NO: 6177 - DNA, 14 bp, Artificial sequence
  synthetic sequence
ctagagggagcttg

SEQ ID NO: 6178 - DNA, 14 bp, Artificial sequence
  synthetic sequence
agagaatttaggcg

SEQ ID NO: 6179 - DNA, 14 bp, Artificial sequence
  synthetic sequence
ccgtaaccgccctt

SEQ ID NO: 6180 - DNA, 14 bp, Artificial sequence
  synthetic sequence
tatgtgcaggggag

SEQ ID NO: 6181 - DNA, 14 bp, Artificial sequence
  synthetic sequence
aacggtgggttcca

SEQ ID NO: 6182 - DNA, 14 bp, Artificial sequence
  synthetic sequence
ataaatccaatcac

SEQ ID NO: 6183 - DNA, 14 bp, Artificial sequence
  synthetic sequence
tagctgactcgggg

SEQ ID NO: 6184 - DNA, 14 bp, Artificial sequence
  synthetic sequence
gattgacgggctcc

SEQ ID NO: 6185 - DNA, 14 bp, Artificial sequence
  synthetic sequence
acttataaggcaac

SEQ ID NO: 6186 - DNA, 14 bp, Artificial sequence
  synthetic sequence
cttgctacacccac

SEQ ID NO: 6187 - DNA, 14 bp, Artificial sequence
  synthetic sequence
tacctcaaaaatga

SEQ ID NO: 6188 - DNA, 14 bp, Artificial sequence
  synthetic sequence
tgaagttcaggcga

SEQ ID NO: 6189 - DNA, 14 bp, Artificial sequence
  synthetic sequence
tgagcccacttacc

SEQ ID NO: 6190 - DNA, 14 bp, Artificial sequence
  synthetic sequence
attaagcaataccc

SEQ ID NO: 6191 - DNA, 14 bp, Artificial sequence
  synthetic sequence
gaaatcttccgcga

SEQ ID NO: 6192 - DNA, 14 bp, Artificial sequence
  synthetic sequence
gaggtagaacaatt

SEQ ID NO: 6193 - DNA, 14 bp, Artificial sequence
  synthetic sequence
gggtacagtcggtg

SEQ ID NO: 6194 - DNA, 14 bp, Artificial sequence
  synthetic sequence
ctgtagggcgtcaa

SEQ ID NO: 6195 - DNA, 14 bp, Artificial sequence
  synthetic sequence
gtaaatcccctacc

SEQ ID NO: 6196 - DNA, 14 bp, Artificial sequence
  synthetic sequence
gaccattgacggtg

SEQ ID NO: 6197 - DNA, 14 bp, Artificial sequence
  synthetic sequence
aatggcgaggtgtg

SEQ ID NO: 6198 - DNA, 14 bp, Artificial sequence
  synthetic sequence
tactgaataacagg

SEQ ID NO: 6199 - DNA, 14 bp, Artificial sequence
  synthetic sequence
atcatagctcccac

SEQ ID NO: 6200 - DNA, 14 bp, Artificial sequence
  synthetic sequence
gcgtccttccccac

SEQ ID NO: 6201 - DNA, 14 bp, Artificial sequence
  synthetic sequence
gctacaactgactg

SEQ ID NO: 6202 - DNA, 14 bp, Artificial sequence
  synthetic sequence
gtggaggcttcagc

SEQ ID NO: 6203 - DNA, 14 bp, Artificial sequence
  synthetic sequence
cgatctatcacccc

SEQ ID NO: 6204 - DNA, 14 bp, Artificial sequence
  synthetic sequence
cccgtctaggcgta

SEQ ID NO: 6205 - DNA, 14 bp, Artificial sequence
  synthetic sequence
ggctgacctaagtc

SEQ ID NO: 6206 - DNA, 14 bp, Artificial sequence
  synthetic sequence
cgactggaagttca

SEQ ID NO: 6207 - DNA, 14 bp, Artificial sequence
  synthetic sequence
agctcaagttcgag

SEQ ID NO: 6208 - DNA, 14 bp, Artificial sequence
  synthetic sequence
cgttgcggctgaca

SEQ ID NO: 6209 - DNA, 14 bp, Artificial sequence
  synthetic sequence
gcctaccggtccgt

SEQ ID NO: 6210 - DNA, 14 bp, Artificial sequence
  synthetic sequence
ggcatacccttggg

SEQ ID NO: 6211 - DNA, 14 bp, Artificial sequence
  synthetic sequence
gaaaacacttgtca

SEQ ID NO: 6212 - DNA, 14 bp, Artificial sequence
  synthetic sequence
gctacgtacagcta

SEQ ID NO: 6213 - DNA, 14 bp, Artificial sequence
  synthetic sequence
tacatgacatacaa

SEQ ID NO: 6214 - DNA, 14 bp, Artificial sequence
  synthetic sequence
aaatgttaccccga

SEQ ID NO: 6215 - DNA, 14 bp, Artificial sequence
  synthetic sequence
cccctgatgatgaa

SEQ ID NO: 6216 - DNA, 14 bp, Artificial sequence
  synthetic sequence
gactctccatgccc

SEQ ID NO: 6217 - DNA, 14 bp, Artificial sequence
  synthetic sequence
acaccttcccgggt

SEQ ID NO: 6218 - DNA, 14 bp, Artificial sequence
  synthetic sequence
gacggctgatatga

SEQ ID NO: 6219 - DNA, 14 bp, Artificial sequence
  synthetic sequence
gggagaggatgatt

SEQ ID NO: 6220 - DNA, 14 bp, Artificial sequence
  synthetic sequence
agataatggaaagt

SEQ ID NO: 6221 - DNA, 14 bp, Artificial sequence
  synthetic sequence
accgtaaacggttg

SEQ ID NO: 6222 - DNA, 14 bp, Artificial sequence
  synthetic sequence
ttataacaaaggca

SEQ ID NO: 6223 - DNA, 14 bp, Artificial sequence
  synthetic sequence
gatgctgacagtca

SEQ ID NO: 6224 - DNA, 14 bp, Artificial sequence
  synthetic sequence
gcaacaattcctca

SEQ ID NO: 6225 - DNA, 14 bp, Artificial sequence
  synthetic sequence
gacgtcatacctac

SEQ ID NO: 6226 - DNA, 14 bp, Artificial sequence
  synthetic sequence
gactggtgaaaatg

SEQ ID NO: 6227 - DNA, 14 bp, Artificial sequence
  synthetic sequence
ctccatcgaatcaa

SEQ ID NO: 6228 - DNA, 14 bp, Artificial sequence
  synthetic sequence
ggtcggggatctca

SEQ ID NO: 6229 - DNA, 14 bp, Artificial sequence
  synthetic sequence
atacgcgaagtgct

SEQ ID NO: 6230 - DNA, 14 bp, Artificial sequence
  synthetic sequence
accggctcggtcct

SEQ ID NO: 6231 - DNA, 14 bp, Artificial sequence
  synthetic sequence
taaatacggtacac

SEQ ID NO: 6232 - DNA, 14 bp, Artificial sequence
  synthetic sequence
tgggactgagctcc

SEQ ID NO: 6233 - DNA, 14 bp, Artificial sequence
  synthetic sequence
gttccaacgccaat

SEQ ID NO: 6234 - DNA, 14 bp, Artificial sequence
  synthetic sequence
ctaaggtaataccg

SEQ ID NO: 6235 - DNA, 14 bp, Artificial sequence
  synthetic sequence
cctcctcggagggt

SEQ ID NO: 6236 - DNA, 14 bp, Artificial sequence
  synthetic sequence
acggtatctatacg

SEQ ID NO: 6237 - DNA, 14 bp, Artificial sequence
  synthetic sequence
atactactaaacta

SEQ ID NO: 6238 - DNA, 14 bp, Artificial sequence
  synthetic sequence
ctacggtgtactac

SEQ ID NO: 6239 - DNA, 14 bp, Artificial sequence
  synthetic sequence
tgctataaaggact

SEQ ID NO: 6240 - DNA, 14 bp, Artificial sequence
  synthetic sequence
aagactttcatcgg

SEQ ID NO: 6241 - DNA, 14 bp, Artificial sequence
  synthetic sequence
cttccggaccctat

SEQ ID NO: 6242 - DNA, 14 bp, Artificial sequence
  synthetic sequence
taaaatgcacttcc

SEQ ID NO: 6243 - DNA, 14 bp, Artificial sequence
  synthetic sequence
aagtcttagtccgg

SEQ ID NO: 6244 - DNA, 14 bp, Artificial sequence
  synthetic sequence
aattctagtacgcc

SEQ ID NO: 6245 - DNA, 14 bp, Artificial sequence
  synthetic sequence
ggccgacgcgtttt

SEQ ID NO: 6246 - DNA, 14 bp, Artificial sequence
  synthetic sequence
tggcatagcgtgtc

SEQ ID NO: 6247 - DNA, 14 bp, Artificial sequence
  synthetic sequence
tattgccccagtag

SEQ ID NO: 6248 - DNA, 14 bp, Artificial sequence
  synthetic sequence
tacaagtctctgag

SEQ ID NO: 6249 - DNA, 14 bp, Artificial sequence
  synthetic sequence
aaaactgtacctgt

SEQ ID NO: 6250 - DNA, 14 bp, Artificial sequence
  synthetic sequence
tcctacggtgtcgg

SEQ ID NO: 6251 - DNA, 14 bp, Artificial sequence
  synthetic sequence
tgtaagctcagcgt

SEQ ID NO: 6252 - DNA, 14 bp, Artificial sequence
  synthetic sequence
cgtacggtaccgtt

SEQ ID NO: 6253 - DNA, 14 bp, Artificial sequence
  synthetic sequence
tggagggtataatg

SEQ ID NO: 6254 - DNA, 14 bp, Artificial sequence
  synthetic sequence
acgcaattctaaat

SEQ ID NO: 6255 - DNA, 14 bp, Artificial sequence
  synthetic sequence
attatgggagatca

SEQ ID NO: 6256 - DNA, 14 bp, Artificial sequence
  synthetic sequence
tcaatgctataggc

SEQ ID NO: 6257 - DNA, 14 bp, Artificial sequence
  synthetic sequence
cgtagttgagtgga

SEQ ID NO: 6258 - DNA, 14 bp, Artificial sequence
  synthetic sequence
acttataccagcta

SEQ ID NO: 6259 - DNA, 14 bp, Artificial sequence
  synthetic sequence
gaatagtaacgctt

SEQ ID NO: 6260 - DNA, 14 bp, Artificial sequence
  synthetic sequence
attggaactgtcac

SEQ ID NO: 6261 - DNA, 14 bp, Artificial sequence
  synthetic sequence
agtactacagattg

SEQ ID NO: 6262 - DNA, 14 bp, Artificial sequence
  synthetic sequence
acccgctatcctct

SEQ ID NO: 6263 - DNA, 14 bp, Artificial sequence
  synthetic sequence
taaactaattgcgg

SEQ ID NO: 6264 - DNA, 14 bp, Artificial sequence
  synthetic sequence
aatactccaatggt

SEQ ID NO: 6265 - DNA, 14 bp, Artificial sequence
  synthetic sequence
gttccagcagttac

SEQ ID NO: 6266 - DNA, 14 bp, Artificial sequence
  synthetic sequence
tcgcatgtaagata

SEQ ID NO: 6267 - DNA, 14 bp, Artificial sequence
  synthetic sequence
tttgcgaagatacg

SEQ ID NO: 6268 - DNA, 14 bp, Artificial sequence
  synthetic sequence
gacccgtgttaaat

SEQ ID NO: 6269 - DNA, 14 bp, Artificial sequence
  synthetic sequence
agtgagtgattggg

SEQ ID NO: 6270 - DNA, 14 bp, Artificial sequence
  synthetic sequence
tgtgtcgctccaca

SEQ ID NO: 6271 - DNA, 14 bp, Artificial sequence
  synthetic sequence
atgatcacatgggt

SEQ ID NO: 6272 - DNA, 14 bp, Artificial sequence
  synthetic sequence
gtactgggtgcaat

SEQ ID NO: 6273 - DNA, 14 bp, Artificial sequence
  synthetic sequence
gaccacttctgctc

SEQ ID NO: 6274 - DNA, 14 bp, Artificial sequence
  synthetic sequence
gtacgtcaatagtg

SEQ ID NO: 6275 - DNA, 14 bp, Artificial sequence
  synthetic sequence
tggccctccgttcc

SEQ ID NO: 6276 - DNA, 14 bp, Artificial sequence
  synthetic sequence
ctggacagtgtctg

SEQ ID NO: 6277 - DNA, 14 bp, Artificial sequence
  synthetic sequence
ggacagtgttcgta

SEQ ID NO: 6278 - DNA, 14 bp, Artificial sequence
  synthetic sequence
tagtgccagggttc

SEQ ID NO: 6279 - DNA, 14 bp, Artificial sequence
  synthetic sequence
tcgggtgctccctg

SEQ ID NO: 6280 - DNA, 14 bp, Artificial sequence
  synthetic sequence
tacattgtgaacgg

SEQ ID NO: 6281 - DNA, 14 bp, Artificial sequence
  synthetic sequence
taggttcaacgtca

SEQ ID NO: 6282 - DNA, 14 bp, Artificial sequence
  synthetic sequence
ccaattgatgaatc

SEQ ID NO: 6283 - DNA, 14 bp, Artificial sequence
  synthetic sequence
gaaactggttctcg

SEQ ID NO: 6284 - DNA, 14 bp, Artificial sequence
  synthetic sequence
tggttgtccgaagc

SEQ ID NO: 6285 - DNA, 14 bp, Artificial sequence
  synthetic sequence
tgtggctcatccga

SEQ ID NO: 6286 - DNA, 14 bp, Artificial sequence
  synthetic sequence
cagagcgtagttat

SEQ ID NO: 6287 - DNA, 14 bp, Artificial sequence
  synthetic sequence
aatttaggcccatc

SEQ ID NO: 6288 - DNA, 14 bp, Artificial sequence
  synthetic sequence
atgaggcgtacatt

SEQ ID NO: 6289 - DNA, 14 bp, Artificial sequence
  synthetic sequence
tgtataaactgcac

SEQ ID NO: 6290 - DNA, 14 bp, Artificial sequence
  synthetic sequence
tacctagatcctac

SEQ ID NO: 6291 - DNA, 14 bp, Artificial sequence
  synthetic sequence
tccagccatatgct

SEQ ID NO: 6292 - DNA, 14 bp, Artificial sequence
  synthetic sequence
tattagctcacgcg

SEQ ID NO: 6293 - DNA, 14 bp, Artificial sequence
  synthetic sequence
tcgattcggtgcgg

SEQ ID NO: 6294 - DNA, 14 bp, Artificial sequence
  synthetic sequence
ctaaatatgagagt

SEQ ID NO: 6295 - DNA, 14 bp, Artificial sequence
  synthetic sequence
gggtgctttcgaca

SEQ ID NO: 6296 - DNA, 14 bp, Artificial sequence
  synthetic sequence
aacagatttacatg

SEQ ID NO: 6297 - DNA, 14 bp, Artificial sequence
  synthetic sequence
aaatagctacatct

SEQ ID NO: 6298 - DNA, 14 bp, Artificial sequence
  synthetic sequence
aatccctgggctta

SEQ ID NO: 6299 - DNA, 14 bp, Artificial sequence
  synthetic sequence
cctaacagctcctt

SEQ ID NO: 6300 - DNA, 14 bp, Artificial sequence
  synthetic sequence
tacagatctcgata

SEQ ID NO: 6301 - DNA, 14 bp, Artificial sequence
  synthetic sequence
agacatgtcttaga

SEQ ID NO: 6302 - DNA, 14 bp, Artificial sequence
  synthetic sequence
taattcccctggcg

SEQ ID NO: 6303 - DNA, 14 bp, Artificial sequence
  synthetic sequence
gtgtagattcgacg

SEQ ID NO: 6304 - DNA, 14 bp, Artificial sequence
  synthetic sequence
cgtagatattccga

SEQ ID NO: 6305 - DNA, 14 bp, Artificial sequence
  synthetic sequence
cttacaatcgcctg

SEQ ID NO: 6306 - DNA, 14 bp, Artificial sequence
  synthetic sequence
cgtacctgggttgg

SEQ ID NO: 6307 - DNA, 14 bp, Artificial sequence
  synthetic sequence
aatccctatagtcc

SEQ ID NO: 6308 - DNA, 14 bp, Artificial sequence
  synthetic sequence
cgtccttcaatcaa

SEQ ID NO: 6309 - DNA, 14 bp, Artificial sequence
  synthetic sequence
tcggagagtcgttg

SEQ ID NO: 6310 - DNA, 14 bp, Artificial sequence
  synthetic sequence
gtgtgttcagaggg

SEQ ID NO: 6311 - DNA, 14 bp, Artificial sequence
  synthetic sequence
cggtaacaatcttc

SEQ ID NO: 6312 - DNA, 14 bp, Artificial sequence
  synthetic sequence
gagctagtaatgta

SEQ ID NO: 6313 - DNA, 14 bp, Artificial sequence
  synthetic sequence
tgtgctcggtacaa

SEQ ID NO: 6314 - DNA, 14 bp, Artificial sequence
  synthetic sequence
tgctctcacatagg

SEQ ID NO: 6315 - DNA, 14 bp, Artificial sequence
  synthetic sequence
catagcgtttgcca

SEQ ID NO: 6316 - DNA, 14 bp, Artificial sequence
  synthetic sequence
ataccacacttcgt

SEQ ID NO: 6317 - DNA, 14 bp, Artificial sequence
  synthetic sequence
ggaccgatttatag

SEQ ID NO: 6318 - DNA, 14 bp, Artificial sequence
  synthetic sequence
acatgtgttccccg

SEQ ID NO: 6319 - DNA, 14 bp, Artificial sequence
  synthetic sequence
ctgggttcgtccca

SEQ ID NO: 6320 - DNA, 14 bp, Artificial sequence
  synthetic sequence
gcggacctcctctt

SEQ ID NO: 6321 - DNA, 14 bp, Artificial sequence
  synthetic sequence
tgctcctaacgata

SEQ ID NO: 6322 - DNA, 14 bp, Artificial sequence
  synthetic sequence
tctagaccaattat

SEQ ID NO: 6323 - DNA, 14 bp, Artificial sequence
  synthetic sequence
ggatcccttcttaa

SEQ ID NO: 6324 - DNA, 14 bp, Artificial sequence
  synthetic sequence
ttgatcgggctgtc

SEQ ID NO: 6325 - DNA, 14 bp, Artificial sequence
  synthetic sequence
gagccgttgttcct

SEQ ID NO: 6326 - DNA, 14 bp, Artificial sequence
  synthetic sequence
ggacttcgctgctt

SEQ ID NO: 6327 - DNA, 14 bp, Artificial sequence
  synthetic sequence
tatcgtgattgggg

SEQ ID NO: 6328 - DNA, 14 bp, Artificial sequence
  synthetic sequence
ttccgggtcgctgt

SEQ ID NO: 6329 - DNA, 14 bp, Artificial sequence
  synthetic sequence
gcgatcggtttgct

SEQ ID NO: 6330 - DNA, 14 bp, Artificial sequence
  synthetic sequence
cccgctttctctga

SEQ ID NO: 6331 - DNA, 14 bp, Artificial sequence
  synthetic sequence
gtacgcgtttcgtc

SEQ ID NO: 6332 - DNA, 14 bp, Artificial sequence
  synthetic sequence
aattcagaatcttc

SEQ ID NO: 6333 - DNA, 14 bp, Artificial sequence
  synthetic sequence
ccatcatggcattt

SEQ ID NO: 6334 - DNA, 14 bp, Artificial sequence
  synthetic sequence
tgtaaacatcctat

SEQ ID NO: 6335 - DNA, 14 bp, Artificial sequence
  synthetic sequence
acttaaatgtacat

SEQ ID NO: 6336 - DNA, 14 bp, Artificial sequence
  synthetic sequence
gttagtcctacggt

SEQ ID NO: 6337 - DNA, 14 bp, Artificial sequence
  synthetic sequence
ctgtaatgtatcgc

SEQ ID NO: 6338 - DNA, 14 bp, Artificial sequence
  synthetic sequence
catctcttgggcgt

SEQ ID NO: 6339 - DNA, 14 bp, Artificial sequence
  synthetic sequence
atgtgacctattgg

SEQ ID NO: 6340 - DNA, 14 bp, Artificial sequence
  synthetic sequence
gagaatctcttata

SEQ ID NO: 6341 - DNA, 14 bp, Artificial sequence
  synthetic sequence
ggtcttagcactta

SEQ ID NO: 6342 - DNA, 14 bp, Artificial sequence
  synthetic sequence
agtcttgacgctct

SEQ ID NO: 6343 - DNA, 14 bp, Artificial sequence
  synthetic sequence
cctatttctcccaa

SEQ ID NO: 6344 - DNA, 14 bp, Artificial sequence
  synthetic sequence
tatgtataagctac

SEQ ID NO: 6345 - DNA, 14 bp, Artificial sequence
  synthetic sequence
actactgcttcgta

SEQ ID NO: 6346 - DNA, 14 bp, Artificial sequence
  synthetic sequence
tcgtcagtttggca

SEQ ID NO: 6347 - DNA, 14 bp, Artificial sequence
  synthetic sequence
taactgtggtggct

SEQ ID NO: 6348 - DNA, 14 bp, Artificial sequence
  synthetic sequence
gtcgatttatgcag

SEQ ID NO: 6349 - DNA, 14 bp, Artificial sequence
  synthetic sequence
cgtatatgtcatac

SEQ ID NO: 6350 - DNA, 14 bp, Artificial sequence
  synthetic sequence
ttatcgtccggatc

SEQ ID NO: 6351 - DNA, 14 bp, Artificial sequence
  synthetic sequence
ttatgggtacgagt

SEQ ID NO: 6352 - DNA, 14 bp, Artificial sequence
  synthetic sequence
tgtttcgtccccgg

SEQ ID NO: 6353 - DNA, 14 bp, Artificial sequence
  synthetic sequence
tctcagacttctgc

SEQ ID NO: 6354 - DNA, 14 bp, Artificial sequence
  synthetic sequence
ctaccatatgtctg

SEQ ID NO: 6355 - DNA, 14 bp, Artificial sequence
  synthetic sequence
gagttggacgtttc

SEQ ID NO: 6356 - DNA, 14 bp, Artificial sequence
  synthetic sequence
attagcctcttcag

SEQ ID NO: 6357 - DNA, 14 bp, Artificial sequence
  synthetic sequence
ctattatgatacga

SEQ ID NO: 6358 - DNA, 14 bp, Artificial sequence
  synthetic sequence
gtatcataccttga

SEQ ID NO: 6359 - DNA, 14 bp, Artificial sequence
  synthetic sequence
ttgtataaaccctg

SEQ ID NO: 6360 - DNA, 14 bp, Artificial sequence
  synthetic sequence
ttccgcgtaaactt

SEQ ID NO: 6361 - DNA, 14 bp, Artificial sequence
  synthetic sequence
tacttgtaaactaa

SEQ ID NO: 6362 - DNA, 14 bp, Artificial sequence
  synthetic sequence
cccctttttcagga

SEQ ID NO: 6363 - DNA, 14 bp, Artificial sequence
  synthetic sequence
tttagtgagagcct

SEQ ID NO: 6364 - DNA, 14 bp, Artificial sequence
  synthetic sequence
aacttttcatagac

SEQ ID NO: 6365 - DNA, 14 bp, Artificial sequence
  synthetic sequence
tcgcttagtaagtt

SEQ ID NO: 6366 - DNA, 14 bp, Artificial sequence
  synthetic sequence
taaacatgcatttt

SEQ ID NO: 6367 - DNA, 14 bp, Artificial sequence
  synthetic sequence
gtttatcccttcga

SEQ ID NO: 6368 - DNA, 14 bp, Artificial sequence
  synthetic sequence
cgattgattcttcc

SEQ ID NO: 6369 - DNA, 14 bp, Artificial sequence
  synthetic sequence
actgtcatcttgta

SEQ ID NO: 6370 - DNA, 14 bp, Artificial sequence
  synthetic sequence
gacttcgtttgcgt

SEQ ID NO: 6371 - DNA, 14 bp, Artificial sequence
  synthetic sequence
ttatatgaggttgt

SEQ ID NO: 6372 - DNA, 14 bp, Artificial sequence
  synthetic sequence
tttcaagattcttc

SEQ ID NO: 6373 - DNA, 14 bp, Artificial sequence
  synthetic sequence
tgatttattccatg

SEQ ID NO: 6374 - DNA, 14 bp, Artificial sequence
  synthetic sequence
ttagagcttcttct

SEQ ID NO: 6375 - DNA, 14 bp, Artificial sequence
  synthetic sequence
cgaatgtgttttta

SEQ ID NO: 6376 - DNA, 14 bp, Artificial sequence
  synthetic sequence
gatgtctacttttg

SEQ ID NO: 6377 - DNA, 14 bp, Artificial sequence
  synthetic sequence
tctgttcgctcatt

SEQ ID NO: 6378 - DNA, 14 bp, Artificial sequence
  synthetic sequence
tttggttcagtgtg

SEQ ID NO: 6379 - DNA, 14 bp, Artificial sequence
  synthetic sequence
gctactccttttat

SEQ ID NO: 6380 - DNA, 14 bp, Artificial sequence
  synthetic sequence
attggtattatgat

SEQ ID NO: 6381 - DNA, 14 bp, Artificial sequence
  synthetic sequence
cgattactatttgt

SEQ ID NO: 6382 - DNA, 14 bp, Artificial sequence
  synthetic sequence
ttagcatatcattt

SEQ ID NO: 6383 - DNA, 14 bp, Artificial sequence
  synthetic sequence
tgttcgaatctttg

SEQ ID NO: 6384 - DNA, 14 bp, Artificial sequence
  synthetic sequence
cccttgttcttctg

SEQ ID NO: 6385 - DNA, 14 bp, Artificial sequence
  synthetic sequence
atgtctgttgttac

SEQ ID NO: 6386 - DNA, 14 bp, Artificial sequence
  synthetic sequence
tatgttttacacta

SEQ ID NO: 6387 - DNA, 14 bp, Artificial sequence
  synthetic sequence
tttacctgttaatg

SEQ ID NO: 6388 - DNA, 14 bp, Artificial sequence
  synthetic sequence
actttatgtgttag

SEQ ID NO: 6389 - DNA, 14 bp, Artificial sequence
  synthetic sequence
atgtgttcctgtta

SEQ ID NO: 6390 - DNA, 14 bp, Artificial sequence
  synthetic sequence
ctcccttacctttt

SEQ ID NO: 6391 - DNA, 14 bp, Artificial sequence
  synthetic sequence
tgtcgttgttgtgc

SEQ ID NO: 6392 - DNA, 14 bp, Artificial sequence
  synthetic sequence
aatttgcgttttac

SEQ ID NO: 6393 - DNA, 14 bp, Artificial sequence
  synthetic sequence
tttttccgactgtg

SEQ ID NO: 6394 - DNA, 14 bp, Artificial sequence
  synthetic sequence
ttttagagtttccc

SEQ ID NO: 6395 - DNA, 14 bp, Artificial sequence
  synthetic sequence
ggcgtgttattgtt

SEQ ID NO: 6396 - DNA, 14 bp, Artificial sequence
  synthetic sequence
tgtgaactttttag

SEQ ID NO: 6397 - DNA, 14 bp, Artificial sequence
  synthetic sequence
tccaacatttttct

SEQ ID NO: 6398 - DNA, 14 bp, Artificial sequence
  synthetic sequence
tatttttggccact

SEQ ID NO: 6399 - DNA, 14 bp, Artificial sequence
  synthetic sequence
gatagttatcttat

SEQ ID NO: 6400 - DNA, 14 bp, Artificial sequence
  synthetic sequence
gttatcttatgcct

SEQ ID NO: 6401 - DNA, 14 bp, Artificial sequence
  synthetic sequence
gttttctgcttagc

SEQ ID NO: 6402 - DNA, 14 bp, Artificial sequence
  synthetic sequence
atttgggagtgttt

SEQ ID NO: 6403 - DNA, 14 bp, Artificial sequence
  synthetic sequence
tgttatgtgctgtc

SEQ ID NO: 6404 - DNA, 14 bp, Artificial sequence
  synthetic sequence
gggtgtatatgttt

SEQ ID NO: 6405 - DNA, 14 bp, Artificial sequence
  synthetic sequence
tgtgtcttatggta

SEQ ID NO: 6406 - DNA, 14 bp, Artificial sequence
  synthetic sequence
tattgtactctact

SEQ ID NO: 6407 - DNA, 14 bp, Artificial sequence
  synthetic sequence
cctaatgatttttc

SEQ ID NO: 6408 - DNA, 14 bp, Artificial sequence
  synthetic sequence
accacactcaacca

SEQ ID NO: 6409 - DNA, 14 bp, Artificial sequence
  synthetic sequence
ctaaacccgggggg

SEQ ID NO: 6410 - DNA, 14 bp, Artificial sequence
  synthetic sequence
cggcatccgacgac

SEQ ID NO: 6411 - DNA, 14 bp, Artificial sequence
  synthetic sequence
gccgatagcccgac

SEQ ID NO: 6412 - DNA, 14 bp, Artificial sequence
  synthetic sequence
aagatccggacggc

SEQ ID NO: 6413 - DNA, 14 bp, Artificial sequence
  synthetic sequence
cagcaggtagcgaa

SEQ ID NO: 6414 - DNA, 14 bp, Artificial sequence
  synthetic sequence
gacaccccaaatgc

SEQ ID NO: 6415 - DNA, 14 bp, Artificial sequence
  synthetic sequence
gactagccaccaca

SEQ ID NO: 6416 - DNA, 14 bp, Artificial sequence
  synthetic sequence
gcgcagctaccaac

SEQ ID NO: 6417 - DNA, 14 bp, Artificial sequence
  synthetic sequence
acgatccgggaccg

SEQ ID NO: 6418 - DNA, 14 bp, Artificial sequence
  synthetic sequence
cgccaaccagatca

SEQ ID NO: 6419 - DNA, 14 bp, Artificial sequence
  synthetic sequence
ggcagccggatgac

SEQ ID NO: 6420 - DNA, 14 bp, Artificial sequence
  synthetic sequence
gagaacgcggtcgg

SEQ ID NO: 6421 - DNA, 14 bp, Artificial sequence
  synthetic sequence
accacccgaacata

SEQ ID NO: 6422 - DNA, 14 bp, Artificial sequence
  synthetic sequence
gacaatagcaacac

SEQ ID NO: 6423 - DNA, 14 bp, Artificial sequence
  synthetic sequence
acaaatgagcaagg

SEQ ID NO: 6424 - DNA, 14 bp, Artificial sequence
  synthetic sequence
agatgaccaaccac

SEQ ID NO: 6425 - DNA, 14 bp, Artificial sequence
  synthetic sequence
agggactggcgggg

SEQ ID NO: 6426 - DNA, 14 bp, Artificial sequence
  synthetic sequence
aggaccggaccctc

SEQ ID NO: 6427 - DNA, 14 bp, Artificial sequence
  synthetic sequence
gcaaatcaaggcga

SEQ ID NO: 6428 - DNA, 14 bp, Artificial sequence
  synthetic sequence
aagacaaaaggcta

SEQ ID NO: 6429 - DNA, 14 bp, Artificial sequence
  synthetic sequence
tcgaccgaccgaac

SEQ ID NO: 6430 - DNA, 14 bp, Artificial sequence
  synthetic sequence
caggtccccaggac

SEQ ID NO: 6431 - DNA, 14 bp, Artificial sequence
  synthetic sequence
gcggatcccaccgg

SEQ ID NO: 6432 - DNA, 14 bp, Artificial sequence
  synthetic sequence
acaggactaacaca

SEQ ID NO: 6433 - DNA, 14 bp, Artificial sequence
  synthetic sequence
gaaggatgccacgc

SEQ ID NO: 6434 - DNA, 14 bp, Artificial sequence
  synthetic sequence
aaaagagcctgcag

SEQ ID NO: 6435 - DNA, 14 bp, Artificial sequence
  synthetic sequence
gagcggagctagca

SEQ ID NO: 6436 - DNA, 14 bp, Artificial sequence
  synthetic sequence
atcgagcgcgcgca

SEQ ID NO: 6437 - DNA, 14 bp, Artificial sequence
  synthetic sequence
gaacaccctccgcc

SEQ ID NO: 6438 - DNA, 14 bp, Artificial sequence
  synthetic sequence
ccgcacgctcaacc

SEQ ID NO: 6439 - DNA, 14 bp, Artificial sequence
  synthetic sequence
cgaagaagtgcaag

SEQ ID NO: 6440 - DNA, 14 bp, Artificial sequence
  synthetic sequence
gtgcaaaaaggacc

SEQ ID NO: 6441 - DNA, 14 bp, Artificial sequence
  synthetic sequence
ggcccaaccctaag

SEQ ID NO: 6442 - DNA, 14 bp, Artificial sequence
  synthetic sequence
gcaaagaaggtcaa

SEQ ID NO: 6443 - DNA, 14 bp, Artificial sequence
  synthetic sequence
gagacaatccccag

SEQ ID NO: 6444 - DNA, 14 bp, Artificial sequence
  synthetic sequence
cagccaaacagtag

SEQ ID NO: 6445 - DNA, 14 bp, Artificial sequence
  synthetic sequence
aggtcagggacgac

SEQ ID NO: 6446 - DNA, 14 bp, Artificial sequence
  synthetic sequence
caacagccgccgta

SEQ ID NO: 6447 - DNA, 14 bp, Artificial sequence
  synthetic sequence
ccgccaggactcga

SEQ ID NO: 6448 - DNA, 14 bp, Artificial sequence
  synthetic sequence
gtccccaacgaagc

SEQ ID NO: 6449 - DNA, 14 bp, Artificial sequence
  synthetic sequence
acgggcacaagcat

SEQ ID NO: 6450 - DNA, 14 bp, Artificial sequence
  synthetic sequence
acccgatggccagg

SEQ ID NO: 6451 - DNA, 14 bp, Artificial sequence
  synthetic sequence
ccaacacggccatc

SEQ ID NO: 6452 - DNA, 14 bp, Artificial sequence
  synthetic sequence
cccagcacgtgggg

SEQ ID NO: 6453 - DNA, 14 bp, Artificial sequence
  synthetic sequence
acgcatgacccccc

SEQ ID NO: 6454 - DNA, 14 bp, Artificial sequence
  synthetic sequence
ccctccaccgaaca

SEQ ID NO: 6455 - DNA, 14 bp, Artificial sequence
  synthetic sequence
gagcccgaagaata

SEQ ID NO: 6456 - DNA, 14 bp, Artificial sequence
  synthetic sequence
ccagcataacgggc

SEQ ID NO: 6457 - DNA, 14 bp, Artificial sequence
  synthetic sequence
atcacagccgagcc

SEQ ID NO: 6458 - DNA, 14 bp, Artificial sequence
  synthetic sequence
gccacccagcctcc

SEQ ID NO: 6459 - DNA, 14 bp, Artificial sequence
  synthetic sequence
ggataacccgcaaa

SEQ ID NO: 6460 - DNA, 14 bp, Artificial sequence
  synthetic sequence
acgcatcccgccaa

SEQ ID NO: 6461 - DNA, 14 bp, Artificial sequence
  synthetic sequence
acgaaaacagtacc

SEQ ID NO: 6462 - DNA, 14 bp, Artificial sequence
  synthetic sequence
tgacaggacacgag

SEQ ID NO: 6463 - DNA, 14 bp, Artificial sequence
  synthetic sequence
gcaggcaaaatggg

SEQ ID NO: 6464 - DNA, 14 bp, Artificial sequence
  synthetic sequence
atgacacggagagc

SEQ ID NO: 6465 - DNA, 14 bp, Artificial sequence
  synthetic sequence
acaggtgccgacca

SEQ ID NO: 6466 - DNA, 14 bp, Artificial sequence
  synthetic sequence
gccgaacggcacat

SEQ ID NO: 6467 - DNA, 14 bp, Artificial sequence
  synthetic sequence
aagtgggccggcca

SEQ ID NO: 6468 - DNA, 14 bp, Artificial sequence
  synthetic sequence
gcgaacgctggccc

SEQ ID NO: 6469 - DNA, 14 bp, Artificial sequence
  synthetic sequence
gcaaaaacgacgta

SEQ ID NO: 6470 - DNA, 14 bp, Artificial sequence
  synthetic sequence
ggaacaaaagtggc

SEQ ID NO: 6471 - DNA, 14 bp, Artificial sequence
  synthetic sequence
acgggcaggaagtc

SEQ ID NO: 6472 - DNA, 14 bp, Artificial sequence
  synthetic sequence
cccacgaaatcgcc

SEQ ID NO: 6473 - DNA, 14 bp, Artificial sequence
  synthetic sequence
tccgcagccaggac

SEQ ID NO: 6474 - DNA, 14 bp, Artificial sequence
  synthetic sequence
tccgaggagcacaa

SEQ ID NO: 6475 - DNA, 14 bp, Artificial sequence
  synthetic sequence
cacaccagtagaga

SEQ ID NO: 6476 - DNA, 14 bp, Artificial sequence
  synthetic sequence
gcccgagtccgaga

SEQ ID NO: 6477 - DNA, 14 bp, Artificial sequence
  synthetic sequence
cgcgaccgcatgcc

SEQ ID NO: 6478 - DNA, 14 bp, Artificial sequence
  synthetic sequence
caccaaatacccac

SEQ ID NO: 6479 - DNA, 14 bp, Artificial sequence
  synthetic sequence
agacctacgccaga

SEQ ID NO: 6480 - DNA, 14 bp, Artificial sequence
  synthetic sequence
cccgaggactggac

SEQ ID NO: 6481 - DNA, 14 bp, Artificial sequence
  synthetic sequence
gataaccgggaagg

SEQ ID NO: 6482 - DNA, 14 bp, Artificial sequence
  synthetic sequence
acctcggaacaaga

SEQ ID NO: 6483 - DNA, 14 bp, Artificial sequence
  synthetic sequence
gcgagcgcagatgg

SEQ ID NO: 6484 - DNA, 14 bp, Artificial sequence
  synthetic sequence
cccgcacctcagca

SEQ ID NO: 6485 - DNA, 14 bp, Artificial sequence
  synthetic sequence
tgcagggaggacca

SEQ ID NO: 6486 - DNA, 14 bp, Artificial sequence
  synthetic sequence
ccgacagaccatgg

SEQ ID NO: 6487 - DNA, 14 bp, Artificial sequence
  synthetic sequence
gacggcagtgcaga

SEQ ID NO: 6488 - DNA, 14 bp, Artificial sequence
  synthetic sequence
cacaagaaatggga

SEQ ID NO: 6489 - DNA, 14 bp, Artificial sequence
  synthetic sequence
aacggccaagcact

SEQ ID NO: 6490 - DNA, 14 bp, Artificial sequence
  synthetic sequence
gaagggctgaacga

SEQ ID NO: 6491 - DNA, 14 bp, Artificial sequence
  synthetic sequence
cagcacaccatgag

SEQ ID NO: 6492 - DNA, 14 bp, Artificial sequence
  synthetic sequence
gggaaagcggaaat

SEQ ID NO: 6493 - DNA, 14 bp, Artificial sequence
  synthetic sequence
gggaggacgcagtg

SEQ ID NO: 6494 - DNA, 14 bp, Artificial sequence
  synthetic sequence
cggagtgccggaag

SEQ ID NO: 6495 - DNA, 14 bp, Artificial sequence
  synthetic sequence
ggagcgatccgcac

SEQ ID NO: 6496 - DNA, 14 bp, Artificial sequence
  synthetic sequence
agaaccaacatgaa

SEQ ID NO: 6497 - DNA, 14 bp, Artificial sequence
  synthetic sequence
gggacccatagacg

SEQ ID NO: 6498 - DNA, 14 bp, Artificial sequence
  synthetic sequence
aataaagagcccac

SEQ ID NO: 6499 - DNA, 14 bp, Artificial sequence
  synthetic sequence
tggacggagagcgg

SEQ ID NO: 6500 - DNA, 14 bp, Artificial sequence
  synthetic sequence
gagaccaccgatcg

SEQ ID NO: 6501 - DNA, 14 bp, Artificial sequence
  synthetic sequence
cgcgagcgcaacgt

SEQ ID NO: 6502 - DNA, 14 bp, Artificial sequence
  synthetic sequence
agcccgataaacaa

SEQ ID NO: 6503 - DNA, 14 bp, Artificial sequence
  synthetic sequence
tgagaagcaaaaac

SEQ ID NO: 6504 - DNA, 14 bp, Artificial sequence
  synthetic sequence
agtccagcgccgcg

SEQ ID NO: 6505 - DNA, 14 bp, Artificial sequence
  synthetic sequence
cgacctgcccgaac

SEQ ID NO: 6506 - DNA, 14 bp, Artificial sequence
  synthetic sequence
gaaaaaccgtgaga

SEQ ID NO: 6507 - DNA, 14 bp, Artificial sequence
  synthetic sequence
agacgtccgagacc

SEQ ID NO: 6508 - DNA, 14 bp, Artificial sequence
  synthetic sequence
ccactgcacgcaca

SEQ ID NO: 6509 - DNA, 14 bp, Artificial sequence
  synthetic sequence
cacagagtccagcg

SEQ ID NO: 6510 - DNA, 14 bp, Artificial sequence
  synthetic sequence
cctagagagccaga

SEQ ID NO: 6511 - DNA, 14 bp, Artificial sequence
  synthetic sequence
cagggatagagcgg

SEQ ID NO: 6512 - DNA, 14 bp, Artificial sequence
  synthetic sequence
caggcagccgcagt

SEQ ID NO: 6513 - DNA, 14 bp, Artificial sequence
  synthetic sequence
gcacgcacgtaccg

SEQ ID NO: 6514 - DNA, 14 bp, Artificial sequence
  synthetic sequence
caaaaggtacaccc

SEQ ID NO: 6515 - DNA, 14 bp, Artificial sequence
  synthetic sequence
ccataagaaagaac

SEQ ID NO: 6516 - DNA, 14 bp, Artificial sequence
  synthetic sequence
cacctccggagcag

SEQ ID NO: 6517 - DNA, 14 bp, Artificial sequence
  synthetic sequence
tgaagcaaacaaga

SEQ ID NO: 6518 - DNA, 14 bp, Artificial sequence
  synthetic sequence
ccatggcacaaacc

SEQ ID NO: 6519 - DNA, 14 bp, Artificial sequence
  synthetic sequence
aacggggaccgatc

SEQ ID NO: 6520 - DNA, 14 bp, Artificial sequence
  synthetic sequence
aactaaacgcagga

SEQ ID NO: 6521 - DNA, 14 bp, Artificial sequence
  synthetic sequence
cgtggccagaggca

SEQ ID NO: 6522 - DNA, 14 bp, Artificial sequence
  synthetic sequence
cccctacgaacgaa

SEQ ID NO: 6523 - DNA, 14 bp, Artificial sequence
  synthetic sequence
ctgagagaaagcaa

SEQ ID NO: 6524 - DNA, 14 bp, Artificial sequence
  synthetic sequence
tcgcccagaagccc

SEQ ID NO: 6525 - DNA, 14 bp, Artificial sequence
  synthetic sequence
gatcacgcacgcgc

SEQ ID NO: 6526 - DNA, 14 bp, Artificial sequence
  synthetic sequence
cacgcactggcaca

SEQ ID NO: 6527 - DNA, 14 bp, Artificial sequence
  synthetic sequence
gggagcccaaataa

SEQ ID NO: 6528 - DNA, 14 bp, Artificial sequence
  synthetic sequence
acacagcaaggtcc

SEQ ID NO: 6529 - DNA, 14 bp, Artificial sequence
  synthetic sequence
aaaggaagaataga

SEQ ID NO: 6530 - DNA, 14 bp, Artificial sequence
  synthetic sequence
cgacgaatcgacac

SEQ ID NO: 6531 - DNA, 14 bp, Artificial sequence
  synthetic sequence
gcgctgagcggagg

SEQ ID NO: 6532 - DNA, 14 bp, Artificial sequence
  synthetic sequence
gcgagaacgggcct

SEQ ID NO: 6533 - DNA, 14 bp, Artificial sequence
  synthetic sequence
cgcagcgcacgagt

SEQ ID NO: 6534 - DNA, 14 bp, Artificial sequence
  synthetic sequence
gtccggacggcagc

SEQ ID NO: 6535 - DNA, 14 bp, Artificial sequence
  synthetic sequence
ctgagccagacacc

SEQ ID NO: 6536 - DNA, 14 bp, Artificial sequence
  synthetic sequence
aaccatcgggcaca

SEQ ID NO: 6537 - DNA, 14 bp, Artificial sequence
  synthetic sequence
cacatacgccccag

SEQ ID NO: 6538 - DNA, 14 bp, Artificial sequence
  synthetic sequence
aggcccaaatacag

SEQ ID NO: 6539 - DNA, 14 bp, Artificial sequence
  synthetic sequence
cgggcaatcagaaa

SEQ ID NO: 6540 - DNA, 14 bp, Artificial sequence
  synthetic sequence
ggaatcagagaaag

SEQ ID NO: 6541 - DNA, 14 bp, Artificial sequence
  synthetic sequence
gaagatacaaccaa

SEQ ID NO: 6542 - DNA, 14 bp, Artificial sequence
  synthetic sequence
ccgactcgagggac

SEQ ID NO: 6543 - DNA, 14 bp, Artificial sequence
  synthetic sequence
tgggcgaacccagc

SEQ ID NO: 6544 - DNA, 14 bp, Artificial sequence
  synthetic sequence
agcctcggcagcac

SEQ ID NO: 6545 - DNA, 14 bp, Artificial sequence
  synthetic sequence
actgcccagaaagg

SEQ ID NO: 6546 - DNA, 14 bp, Artificial sequence
  synthetic sequence
cacccccaccagtc

SEQ ID NO: 6547 - DNA, 14 bp, Artificial sequence
  synthetic sequence
cccagagaacgatg

SEQ ID NO: 6548 - DNA, 14 bp, Artificial sequence
  synthetic sequence
cgtagacaccaaac

SEQ ID NO: 6549 - DNA, 14 bp, Artificial sequence
  synthetic sequence
cagccatacgcgga

SEQ ID NO: 6550 - DNA, 14 bp, Artificial sequence
  synthetic sequence
gggtaacagagaag

SEQ ID NO: 6551 - DNA, 14 bp, Artificial sequence
  synthetic sequence
cacctgcaccgaga

SEQ ID NO: 6552 - DNA, 14 bp, Artificial sequence
  synthetic sequence
gaggataagagaga

SEQ ID NO: 6553 - DNA, 14 bp, Artificial sequence
  synthetic sequence
gggagacaccaggt

SEQ ID NO: 6554 - DNA, 14 bp, Artificial sequence
  synthetic sequence
ccgacaagcaatcc

SEQ ID NO: 6555 - DNA, 14 bp, Artificial sequence
  synthetic sequence
ccagatgctaaggc

SEQ ID NO: 6556 - DNA, 14 bp, Artificial sequence
  synthetic sequence
aggatatcagagca

SEQ ID NO: 6557 - DNA, 14 bp, Artificial sequence
  synthetic sequence
gtacacgaggacct

SEQ ID NO: 6558 - DNA, 14 bp, Artificial sequence
  synthetic sequence
cgagtccggtcgac

SEQ ID NO: 6559 - DNA, 14 bp, Artificial sequence
  synthetic sequence
gcatggactcaaac

SEQ ID NO: 6560 - DNA, 14 bp, Artificial sequence
  synthetic sequence
gtaggtgacgcgag

SEQ ID NO: 6561 - DNA, 14 bp, Artificial sequence
  synthetic sequence
gagcgggagtgcta

SEQ ID NO: 6562 - DNA, 14 bp, Artificial sequence
  synthetic sequence
ggaaggctggcgta

SEQ ID NO: 6563 - DNA, 14 bp, Artificial sequence
  synthetic sequence
agcagggggtctcg

SEQ ID NO: 6564 - DNA, 14 bp, Artificial sequence
  synthetic sequence
tagagaaggaggtc

SEQ ID NO: 6565 - DNA, 14 bp, Artificial sequence
  synthetic sequence
ggaggccctggtcc

SEQ ID NO: 6566 - DNA, 14 bp, Artificial sequence
  synthetic sequence
agtgcgaccgaagt

SEQ ID NO: 6567 - DNA, 14 bp, Artificial sequence
  synthetic sequence
ctagcagcaagctg

SEQ ID NO: 6568 - DNA, 14 bp, Artificial sequence
  synthetic sequence
agttgccagagcgg

SEQ ID NO: 6569 - DNA, 14 bp, Artificial sequence
  synthetic sequence
ctaccacggggtcc

SEQ ID NO: 6570 - DNA, 14 bp, Artificial sequence
  synthetic sequence
tagtaagaaggcac

SEQ ID NO: 6571 - DNA, 14 bp, Artificial sequence
  synthetic sequence
cgtaggacggctgg

SEQ ID NO: 6572 - DNA, 14 bp, Artificial sequence
  synthetic sequence
agtcgtacccggcc

SEQ ID NO: 6573 - DNA, 14 bp, Artificial sequence
  synthetic sequence
taccgcctggcacg

SEQ ID NO: 6574 - DNA, 14 bp, Artificial sequence
  synthetic sequence
gttacacacggcgc

SEQ ID NO: 6575 - DNA, 14 bp, Artificial sequence
  synthetic sequence
tgcataccgcgagc

SEQ ID NO: 6576 - DNA, 14 bp, Artificial sequence
  synthetic sequence
tcaggcgagggtac

SEQ ID NO: 6577 - DNA, 14 bp, Artificial sequence
  synthetic sequence
agcagtaccgtcag

SEQ ID NO: 6578 - DNA, 14 bp, Artificial sequence
  synthetic sequence
cgggagcgataatc

SEQ ID NO: 6579 - DNA, 14 bp, Artificial sequence
  synthetic sequence
ccggtaccgtaggg

SEQ ID NO: 6580 - DNA, 14 bp, Artificial sequence
  synthetic sequence
tggaggatcacaag

SEQ ID NO: 6581 - DNA, 14 bp, Artificial sequence
  synthetic sequence
aagccacggtatac

SEQ ID NO: 6582 - DNA, 14 bp, Artificial sequence
  synthetic sequence
aaggctggagccct

SEQ ID NO: 6583 - DNA, 14 bp, Artificial sequence
  synthetic sequence
agtacccgtgcgag

SEQ ID NO: 6584 - DNA, 14 bp, Artificial sequence
  synthetic sequence
ggagcctacccgtc

SEQ ID NO: 6585 - DNA, 14 bp, Artificial sequence
  synthetic sequence
aatcacgggtcaag

SEQ ID NO: 6586 - DNA, 14 bp, Artificial sequence
  synthetic sequence
acagtacgagtggg

SEQ ID NO: 6587 - DNA, 14 bp, Artificial sequence
  synthetic sequence
cgcgagacttaagc

SEQ ID NO: 6588 - DNA, 14 bp, Artificial sequence
  synthetic sequence
gtagagacgcctgc

SEQ ID NO: 6589 - DNA, 14 bp, Artificial sequence
  synthetic sequence
taagcgaaactggc

SEQ ID NO: 6590 - DNA, 14 bp, Artificial sequence
  synthetic sequence
aaacccagattgca

SEQ ID NO: 6591 - DNA, 14 bp, Artificial sequence
  synthetic sequence
atcgaatcgacaga

SEQ ID NO: 6592 - DNA, 14 bp, Artificial sequence
  synthetic sequence
aaacgtagacgtag

SEQ ID NO: 6593 - DNA, 14 bp, Artificial sequence
  synthetic sequence
taacggcactacag

SEQ ID NO: 6594 - DNA, 14 bp, Artificial sequence
  synthetic sequence
cgatcacacggggt

SEQ ID NO: 6595 - DNA, 14 bp, Artificial sequence
  synthetic sequence
aagctagggcgtga

SEQ ID NO: 6596 - DNA, 14 bp, Artificial sequence
  synthetic sequence
gtaggtaaccgagc

SEQ ID NO: 6597 - DNA, 14 bp, Artificial sequence
  synthetic sequence
ggtcaacgcctgcc

SEQ ID NO: 6598 - DNA, 14 bp, Artificial sequence
  synthetic sequence
gatcacgtcagaca

SEQ ID NO: 6599 - DNA, 14 bp, Artificial sequence
  synthetic sequence
cagcatgctgggcg

SEQ ID NO: 6600 - DNA, 14 bp, Artificial sequence
  synthetic sequence
cgagctaacgatac

SEQ ID NO: 6601 - DNA, 14 bp, Artificial sequence
  synthetic sequence
gctggaaacgtccg

SEQ ID NO: 6602 - DNA, 14 bp, Artificial sequence
  synthetic sequence
gggtgaggtcagac

SEQ ID NO: 6603 - DNA, 14 bp, Artificial sequence
  synthetic sequence
ggtctaccgcagag

SEQ ID NO: 6604 - DNA, 14 bp, Artificial sequence
  synthetic sequence
ttgagcagccaaac

SEQ ID NO: 6605 - DNA, 14 bp, Artificial sequence
  synthetic sequence
accccgagagtggt

SEQ ID NO: 6606 - DNA, 14 bp, Artificial sequence
  synthetic sequence
gccccactacgtca

SEQ ID NO: 6607 - DNA, 14 bp, Artificial sequence
  synthetic sequence
ctagaccgatgaca

SEQ ID NO: 6608 - DNA, 14 bp, Artificial sequence
  synthetic sequence
agcatggaaggtga

SEQ ID NO: 6609 - DNA, 14 bp, Artificial sequence
  synthetic sequence
tgcgccaatacaga

SEQ ID NO: 6610 - DNA, 14 bp, Artificial sequence
  synthetic sequence
cgcccttcacggca

SEQ ID NO: 6611 - DNA, 14 bp, Artificial sequence
  synthetic sequence
gtggtcgcggagcc

SEQ ID NO: 6612 - DNA, 14 bp, Artificial sequence
  synthetic sequence
ggttgaccacaacc

SEQ ID NO: 6613 - DNA, 14 bp, Artificial sequence
  synthetic sequence
aggagaagattgga

SEQ ID NO: 6614 - DNA, 14 bp, Artificial sequence
  synthetic sequence
ctcgtcggcgaaac

SEQ ID NO: 6615 - DNA, 14 bp, Artificial sequence
  synthetic sequence
cccatagtaccaca

SEQ ID NO: 6616 - DNA, 14 bp, Artificial sequence
  synthetic sequence
aaaccgaggcttcg

SEQ ID NO: 6617 - DNA, 14 bp, Artificial sequence
  synthetic sequence
cgcatcggggtgcg

SEQ ID NO: 6618 - DNA, 14 bp, Artificial sequence
  synthetic sequence
gtccggacgcacct

SEQ ID NO: 6619 - DNA, 14 bp, Artificial sequence
  synthetic sequence
aagaaggtcacgtg

SEQ ID NO: 6620 - DNA, 14 bp, Artificial sequence
  synthetic sequence
cccggacaagtgta

SEQ ID NO: 6621 - DNA, 14 bp, Artificial sequence
  synthetic sequence
gcgagctcaaccct

SEQ ID NO: 6622 - DNA, 14 bp, Artificial sequence
  synthetic sequence
caagacgatcagat

SEQ ID NO: 6623 - DNA, 14 bp, Artificial sequence
  synthetic sequence
taggaatggacgga

SEQ ID NO: 6624 - DNA, 14 bp, Artificial sequence
  synthetic sequence
ccaactatggagac

SEQ ID NO: 6625 - DNA, 14 bp, Artificial sequence
  synthetic sequence
tggaaaacacgcat

SEQ ID NO: 6626 - DNA, 14 bp, Artificial sequence
  synthetic sequence
aaaacaagatacgt

SEQ ID NO: 6627 - DNA, 14 bp, Artificial sequence
  synthetic sequence
taacgctggaagaa

SEQ ID NO: 6628 - DNA, 14 bp, Artificial sequence
  synthetic sequence
gacgcgaatagatg

SEQ ID NO: 6629 - DNA, 14 bp, Artificial sequence
  synthetic sequence
cagggcgattccga

SEQ ID NO: 6630 - DNA, 14 bp, Artificial sequence
  synthetic sequence
tcacgcacgataaa

SEQ ID NO: 6631 - DNA, 14 bp, Artificial sequence
  synthetic sequence
tatacagggggagc

SEQ ID NO: 6632 - DNA, 14 bp, Artificial sequence
  synthetic sequence
cggtctccggaaaa

SEQ ID NO: 6633 - DNA, 14 bp, Artificial sequence
  synthetic sequence
ggtcatagaccgca

SEQ ID NO: 6634 - DNA, 14 bp, Artificial sequence
  synthetic sequence
ctcgggaggtccga

SEQ ID NO: 6635 - DNA, 14 bp, Artificial sequence
  synthetic sequence
gtgaaggtggggcc

SEQ ID NO: 6636 - DNA, 14 bp, Artificial sequence
  synthetic sequence
aactcgaggaactg

SEQ ID NO: 6637 - DNA, 14 bp, Artificial sequence
  synthetic sequence
gtagggacggtccg

SEQ ID NO: 6638 - DNA, 14 bp, Artificial sequence
  synthetic sequence
accaggccttggac

SEQ ID NO: 6639 - DNA, 14 bp, Artificial sequence
  synthetic sequence
aactggtccgggac

SEQ ID NO: 6640 - DNA, 14 bp, Artificial sequence
  synthetic sequence
aagatcggcgtacc

SEQ ID NO: 6641 - DNA, 14 bp, Artificial sequence
  synthetic sequence
tcccgagcatcgac

SEQ ID NO: 6642 - DNA, 14 bp, Artificial sequence
  synthetic sequence
ggccagtcagtgca

SEQ ID NO: 6643 - DNA, 14 bp, Artificial sequence
  synthetic sequence
cgagaatcgtggca

SEQ ID NO: 6644 - DNA, 14 bp, Artificial sequence
  synthetic sequence
ggaactagcgtaac

SEQ ID NO: 6645 - DNA, 14 bp, Artificial sequence
  synthetic sequence
gaaactatgaaaca

SEQ ID NO: 6646 - DNA, 14 bp, Artificial sequence
  synthetic sequence
tgaaaccctgaccc

SEQ ID NO: 6647 - DNA, 14 bp, Artificial sequence
  synthetic sequence
cagagctgcccatg

SEQ ID NO: 6648 - DNA, 14 bp, Artificial sequence
  synthetic sequence
accgggaatcggat

SEQ ID NO: 6649 - DNA, 14 bp, Artificial sequence
  synthetic sequence
gctatcgcgaaggc

SEQ ID NO: 6650 - DNA, 14 bp, Artificial sequence
  synthetic sequence
gacagataactgca

SEQ ID NO: 6651 - DNA, 14 bp, Artificial sequence
  synthetic sequence
tgacaaagaagctg

SEQ ID NO: 6652 - DNA, 14 bp, Artificial sequence
  synthetic sequence
ggaagagtcgtgag

SEQ ID NO: 6653 - DNA, 14 bp, Artificial sequence
  synthetic sequence
ggcgctatgggaaa

SEQ ID NO: 6654 - DNA, 14 bp, Artificial sequence
  synthetic sequence
gaaaccgacaatct

SEQ ID NO: 6655 - DNA, 14 bp, Artificial sequence
  synthetic sequence
cccctctcacacag

SEQ ID NO: 6656 - DNA, 14 bp, Artificial sequence
  synthetic sequence
ctaggacgaatgag

SEQ ID NO: 6657 - DNA, 14 bp, Artificial sequence
  synthetic sequence
ggggtgaggacctg

SEQ ID NO: 6658 - DNA, 14 bp, Artificial sequence
  synthetic sequence
cgtccagtgaccca

SEQ ID NO: 6659 - DNA, 14 bp, Artificial sequence
  synthetic sequence
ggacgcggaaatat

SEQ ID NO: 6660 - DNA, 14 bp, Artificial sequence
  synthetic sequence
agaaaagaccttgg

SEQ ID NO: 6661 - DNA, 14 bp, Artificial sequence
  synthetic sequence
aaccgggtgaatga

SEQ ID NO: 6662 - DNA, 14 bp, Artificial sequence
  synthetic sequence
cgcacggcctacgt

SEQ ID NO: 6663 - DNA, 14 bp, Artificial sequence
  synthetic sequence
gaccacatggtgcc

SEQ ID NO: 6664 - DNA, 14 bp, Artificial sequence
  synthetic sequence
cacgaacagttgcc

SEQ ID NO: 6665 - DNA, 14 bp, Artificial sequence
  synthetic sequence
catctacaacagcc

SEQ ID NO: 6666 - DNA, 14 bp, Artificial sequence
  synthetic sequence
gacataagtacggg

SEQ ID NO: 6667 - DNA, 14 bp, Artificial sequence
  synthetic sequence
ctaaggacaagtgc

SEQ ID NO: 6668 - DNA, 14 bp, Artificial sequence
  synthetic sequence
actcagcaacggta

SEQ ID NO: 6669 - DNA, 14 bp, Artificial sequence
  synthetic sequence
ggcaccggtcgtcg

SEQ ID NO: 6670 - DNA, 14 bp, Artificial sequence
  synthetic sequence
gttcagaagaggcg

SEQ ID NO: 6671 - DNA, 14 bp, Artificial sequence
  synthetic sequence
tgacgctacggggg

SEQ ID NO: 6672 - DNA, 14 bp, Artificial sequence
  synthetic sequence
tccgcgtcacggag

SEQ ID NO: 6673 - DNA, 14 bp, Artificial sequence
  synthetic sequence
aagaactgcaccta

SEQ ID NO: 6674 - DNA, 14 bp, Artificial sequence
  synthetic sequence
tacagccatgacaa

SEQ ID NO: 6675 - DNA, 14 bp, Artificial sequence
  synthetic sequence
tgccctaagaaccc

SEQ ID NO: 6676 - DNA, 14 bp, Artificial sequence
  synthetic sequence
cgagcactgagtac

SEQ ID NO: 6677 - DNA, 14 bp, Artificial sequence
  synthetic sequence
cgctaaacactgac

SEQ ID NO: 6678 - DNA, 14 bp, Artificial sequence
  synthetic sequence
ggctatggccgcgg

SEQ ID NO: 6679 - DNA, 14 bp, Artificial sequence
  synthetic sequence
ttggcgcaagaaga

SEQ ID NO: 6680 - DNA, 14 bp, Artificial sequence
  synthetic sequence
tctaccgccagacg

SEQ ID NO: 6681 - DNA, 14 bp, Artificial sequence
  synthetic sequence
gctataaccagaac

SEQ ID NO: 6682 - DNA, 14 bp, Artificial sequence
  synthetic sequence
taacgatccgcgcc

SEQ ID NO: 6683 - DNA, 14 bp, Artificial sequence
  synthetic sequence
ccaaggcataacat

SEQ ID NO: 6684 - DNA, 14 bp, Artificial sequence
  synthetic sequence
tgcccgtgcaacca

SEQ ID NO: 6685 - DNA, 14 bp, Artificial sequence
  synthetic sequence
acatgctggcgaaa

SEQ ID NO: 6686 - DNA, 14 bp, Artificial sequence
  synthetic sequence
atagggaataaaag

SEQ ID NO: 6687 - DNA, 14 bp, Artificial sequence
  synthetic sequence
gggaatagtgaaaa

SEQ ID NO: 6688 - DNA, 14 bp, Artificial sequence
  synthetic sequence
gcatcaccggcagt

SEQ ID NO: 6689 - DNA, 14 bp, Artificial sequence
  synthetic sequence
aaaccgccgggctt

SEQ ID NO: 6690 - DNA, 14 bp, Artificial sequence
  synthetic sequence
tgacacaatcacgc

SEQ ID NO: 6691 - DNA, 14 bp, Artificial sequence
  synthetic sequence
taacggtggacccg

SEQ ID NO: 6692 - DNA, 14 bp, Artificial sequence
  synthetic sequence
cgacaaaggtcagt

SEQ ID NO: 6693 - DNA, 14 bp, Artificial sequence
  synthetic sequence
gagtcgagcacctc

SEQ ID NO: 6694 - DNA, 14 bp, Artificial sequence
  synthetic sequence
agatggatacagca

SEQ ID NO: 6695 - DNA, 14 bp, Artificial sequence
  synthetic sequence
gcaatgcccagagt

SEQ ID NO: 6696 - DNA, 14 bp, Artificial sequence
  synthetic sequence
ctcacccacccggt

SEQ ID NO: 6697 - DNA, 14 bp, Artificial sequence
  synthetic sequence
gcacatcctcacaa

SEQ ID NO: 6698 - DNA, 14 bp, Artificial sequence
  synthetic sequence
gtctggaaagcccc

SEQ ID NO: 6699 - DNA, 14 bp, Artificial sequence
  synthetic sequence
gaaaagtcggcaat

SEQ ID NO: 6700 - DNA, 14 bp, Artificial sequence
  synthetic sequence
gtgtgaccggacga

SEQ ID NO: 6701 - DNA, 14 bp, Artificial sequence
  synthetic sequence
ccggtgcacctgga

SEQ ID NO: 6702 - DNA, 14 bp, Artificial sequence
  synthetic sequence
cgggacagaacctt

SEQ ID NO: 6703 - DNA, 14 bp, Artificial sequence
  synthetic sequence
agtgtagccgccgg

SEQ ID NO: 6704 - DNA, 14 bp, Artificial sequence
  synthetic sequence
ggtgccaccagtga

SEQ ID NO: 6705 - DNA, 14 bp, Artificial sequence
  synthetic sequence
tcaggcccagacat

SEQ ID NO: 6706 - DNA, 14 bp, Artificial sequence
  synthetic sequence
gggtccccagactg

SEQ ID NO: 6707 - DNA, 14 bp, Artificial sequence
  synthetic sequence
actggggagcaatg

SEQ ID NO: 6708 - DNA, 14 bp, Artificial sequence
  synthetic sequence
ccccgtcaatgcca

SEQ ID NO: 6709 - DNA, 14 bp, Artificial sequence
  synthetic sequence
ggccctgtcgaacg

SEQ ID NO: 6710 - DNA, 14 bp, Artificial sequence
  synthetic sequence
caacttgcggcggg

SEQ ID NO: 6711 - DNA, 14 bp, Artificial sequence
  synthetic sequence
agtccacgacgtcc

SEQ ID NO: 6712 - DNA, 14 bp, Artificial sequence
  synthetic sequence
acctcgaggtagaa

SEQ ID NO: 6713 - DNA, 14 bp, Artificial sequence
  synthetic sequence
cctaaccggaaatc

SEQ ID NO: 6714 - DNA, 14 bp, Artificial sequence
  synthetic sequence
cccagccgtgtcgc

SEQ ID NO: 6715 - DNA, 14 bp, Artificial sequence
  synthetic sequence
ccggtcgatcgaga

SEQ ID NO: 6716 - DNA, 14 bp, Artificial sequence
  synthetic sequence
cctatcgccgacga

SEQ ID NO: 6717 - DNA, 14 bp, Artificial sequence
  synthetic sequence
ggcgtctgacgcga

SEQ ID NO: 6718 - DNA, 14 bp, Artificial sequence
  synthetic sequence
gaactcgggactcc

SEQ ID NO: 6719 - DNA, 14 bp, Artificial sequence
  synthetic sequence
gaagccgagcttac

SEQ ID NO: 6720 - DNA, 14 bp, Artificial sequence
  synthetic sequence
gaatgcccgagaat

SEQ ID NO: 6721 - DNA, 14 bp, Artificial sequence
  synthetic sequence
gggaacatgaacat

SEQ ID NO: 6722 - DNA, 14 bp, Artificial sequence
  synthetic sequence
tgatcacggcaaga

SEQ ID NO: 6723 - DNA, 14 bp, Artificial sequence
  synthetic sequence
cccatcccctaaac

SEQ ID NO: 6724 - DNA, 14 bp, Artificial sequence
  synthetic sequence
ggaatcggaggtcc

SEQ ID NO: 6725 - DNA, 14 bp, Artificial sequence
  synthetic sequence
tacataagaggaac

SEQ ID NO: 6726 - DNA, 14 bp, Artificial sequence
  synthetic sequence
aaactcatcaccgg

SEQ ID NO: 6727 - DNA, 14 bp, Artificial sequence
  synthetic sequence
cccggtacaatgac

SEQ ID NO: 6728 - DNA, 14 bp, Artificial sequence
  synthetic sequence
ggctacccgctcgc

SEQ ID NO: 6729 - DNA, 14 bp, Artificial sequence
  synthetic sequence
actcagcgaaactg

SEQ ID NO: 6730 - DNA, 14 bp, Artificial sequence
  synthetic sequence
actgtcacggggga

SEQ ID NO: 6731 - DNA, 14 bp, Artificial sequence
  synthetic sequence
aaggctgcgtgaaa

SEQ ID NO: 6732 - DNA, 14 bp, Artificial sequence
  synthetic sequence
agtctaagacacca

SEQ ID NO: 6733 - DNA, 14 bp, Artificial sequence
  synthetic sequence
atctggagggagcc

SEQ ID NO: 6734 - DNA, 14 bp, Artificial sequence
  synthetic sequence
ccggagacattgaa

SEQ ID NO: 6735 - DNA, 14 bp, Artificial sequence
  synthetic sequence
ggagacccattcac

SEQ ID NO: 6736 - DNA, 14 bp, Artificial sequence
  synthetic sequence
catcgtcggaaccc

SEQ ID NO: 6737 - DNA, 14 bp, Artificial sequence
  synthetic sequence
aaaataggtgcgaa

SEQ ID NO: 6738 - DNA, 14 bp, Artificial sequence
  synthetic sequence
aaaaccagatctag

SEQ ID NO: 6739 - DNA, 14 bp, Artificial sequence
  synthetic sequence
cgcacctgaaggat

SEQ ID NO: 6740 - DNA, 14 bp, Artificial sequence
  synthetic sequence
tactaccaccgggc

SEQ ID NO: 6741 - DNA, 14 bp, Artificial sequence
  synthetic sequence
tctccgccaaagca

SEQ ID NO: 6742 - DNA, 14 bp, Artificial sequence
  synthetic sequence
taccaccgaatacc

SEQ ID NO: 6743 - DNA, 14 bp, Artificial sequence
  synthetic sequence
cgcggatagacatc

SEQ ID NO: 6744 - DNA, 14 bp, Artificial sequence
  synthetic sequence
aagagtcaagtgcg

SEQ ID NO: 6745 - DNA, 14 bp, Artificial sequence
  synthetic sequence
aaagagattacacg

SEQ ID NO: 6746 - DNA, 14 bp, Artificial sequence
  synthetic sequence
gcagaccacgctat

SEQ ID NO: 6747 - DNA, 14 bp, Artificial sequence
  synthetic sequence
cacgctgtgcggac

SEQ ID NO: 6748 - DNA, 14 bp, Artificial sequence
  synthetic sequence
cctcggagacctcg

SEQ ID NO: 6749 - DNA, 14 bp, Artificial sequence
  synthetic sequence
aggggagcattaac

SEQ ID NO: 6750 - DNA, 14 bp, Artificial sequence
  synthetic sequence
gcattggacggggg

SEQ ID NO: 6751 - DNA, 14 bp, Artificial sequence
  synthetic sequence
tgaaaagaacagtc

SEQ ID NO: 6752 - DNA, 14 bp, Artificial sequence
  synthetic sequence
cccaccacccgtct

SEQ ID NO: 6753 - DNA, 14 bp, Artificial sequence
  synthetic sequence
tgaccgggtcagca

SEQ ID NO: 6754 - DNA, 14 bp, Artificial sequence
  synthetic sequence
cacttaaacgcaaa

SEQ ID NO: 6755 - DNA, 14 bp, Artificial sequence
  synthetic sequence
ctccctgccaccaa

SEQ ID NO: 6756 - DNA, 14 bp, Artificial sequence
  synthetic sequence
cgcaggtccatggc

SEQ ID NO: 6757 - DNA, 14 bp, Artificial sequence
  synthetic sequence
ggtgtgagagcggg

SEQ ID NO: 6758 - DNA, 14 bp, Artificial sequence
  synthetic sequence
tgagaaggcgcctg

SEQ ID NO: 6759 - DNA, 14 bp, Artificial sequence
  synthetic sequence
gcataatggccgag

SEQ ID NO: 6760 - DNA, 14 bp, Artificial sequence
  synthetic sequence
actgccggtgggca

SEQ ID NO: 6761 - DNA, 14 bp, Artificial sequence
  synthetic sequence
gagcaacgggggtt

SEQ ID NO: 6762 - DNA, 14 bp, Artificial sequence
  synthetic sequence
gagtccactggagg

SEQ ID NO: 6763 - DNA, 14 bp, Artificial sequence
  synthetic sequence
ccagttccccaaaa

SEQ ID NO: 6764 - DNA, 14 bp, Artificial sequence
  synthetic sequence
cgaaaggcatcagt

SEQ ID NO: 6765 - DNA, 14 bp, Artificial sequence
  synthetic sequence
aactagacaaagct

SEQ ID NO: 6766 - DNA, 14 bp, Artificial sequence
  synthetic sequence
aaaaacctcgctcc

SEQ ID NO: 6767 - DNA, 14 bp, Artificial sequence
  synthetic sequence
gccgtagatggagg

SEQ ID NO: 6768 - DNA, 14 bp, Artificial sequence
  synthetic sequence
ctaccgataaaagg

SEQ ID NO: 6769 - DNA, 14 bp, Artificial sequence
  synthetic sequence
gaactgatgagagg

SEQ ID NO: 6770 - DNA, 14 bp, Artificial sequence
  synthetic sequence
gaatactccaacac

SEQ ID NO: 6771 - DNA, 14 bp, Artificial sequence
  synthetic sequence
gacatagataaaca

SEQ ID NO: 6772 - DNA, 14 bp, Artificial sequence
  synthetic sequence
aagccggttaggcg

SEQ ID NO: 6773 - DNA, 14 bp, Artificial sequence
  synthetic sequence
gccatccagcggtg

SEQ ID NO: 6774 - DNA, 14 bp, Artificial sequence
  synthetic sequence
acgtgcgacctggg

SEQ ID NO: 6775 - DNA, 14 bp, Artificial sequence
  synthetic sequence
aaccctcgaggtgg

SEQ ID NO: 6776 - DNA, 14 bp, Artificial sequence
  synthetic sequence
aggccaccgctcat

SEQ ID NO: 6777 - DNA, 14 bp, Artificial sequence
  synthetic sequence
aacacgcattaaac

SEQ ID NO: 6778 - DNA, 14 bp, Artificial sequence
  synthetic sequence
cccccatcaacggt

SEQ ID NO: 6779 - DNA, 14 bp, Artificial sequence
  synthetic sequence
tcatagccagggaa

SEQ ID NO: 6780 - DNA, 14 bp, Artificial sequence
  synthetic sequence
agttagggccgcca

SEQ ID NO: 6781 - DNA, 14 bp, Artificial sequence
  synthetic sequence
cggaatgaatggac

SEQ ID NO: 6782 - DNA, 14 bp, Artificial sequence
  synthetic sequence
cgaatagggcgaat

SEQ ID NO: 6783 - DNA, 14 bp, Artificial sequence
  synthetic sequence
attgagaacgccga

SEQ ID NO: 6784 - DNA, 14 bp, Artificial sequence
  synthetic sequence
taatccaagaacgc

SEQ ID NO: 6785 - DNA, 14 bp, Artificial sequence
  synthetic sequence
cagggccttaagca

SEQ ID NO: 6786 - DNA, 14 bp, Artificial sequence
  synthetic sequence
tgaggtaccgggac

SEQ ID NO: 6787 - DNA, 14 bp, Artificial sequence
  synthetic sequence
aaaggcttgccgaa

SEQ ID NO: 6788 - DNA, 14 bp, Artificial sequence
  synthetic sequence
tggccacggctacg

SEQ ID NO: 6789 - DNA, 14 bp, Artificial sequence
  synthetic sequence
aatcgtgcgggaga

SEQ ID NO: 6790 - DNA, 14 bp, Artificial sequence
  synthetic sequence
aggggaagctactg

SEQ ID NO: 6791 - DNA, 14 bp, Artificial sequence
  synthetic sequence
gtctcggggaggac

SEQ ID NO: 6792 - DNA, 14 bp, Artificial sequence
  synthetic sequence
atcagtgggggccg

SEQ ID NO: 6793 - DNA, 14 bp, Artificial sequence
  synthetic sequence
cccctgggagagct

SEQ ID NO: 6794 - DNA, 14 bp, Artificial sequence
  synthetic sequence
acaatacaatggac

SEQ ID NO: 6795 - DNA, 14 bp, Artificial sequence
  synthetic sequence
ggtccgcactgcac

SEQ ID NO: 6796 - DNA, 14 bp, Artificial sequence
  synthetic sequence
ggttgcgacgcgcg

SEQ ID NO: 6797 - DNA, 14 bp, Artificial sequence
  synthetic sequence
cctcggcaggtcaa

SEQ ID NO: 6798 - DNA, 14 bp, Artificial sequence
  synthetic sequence
tgcgtgccccacac

SEQ ID NO: 6799 - DNA, 14 bp, Artificial sequence
  synthetic sequence
tcggagtgacaacc

SEQ ID NO: 6800 - DNA, 14 bp, Artificial sequence
  synthetic sequence
tggcgcaacacgct

SEQ ID NO: 6801 - DNA, 14 bp, Artificial sequence
  synthetic sequence
ataaacaacgataa

SEQ ID NO: 6802 - DNA, 14 bp, Artificial sequence
  synthetic sequence
cacgtccccataca

SEQ ID NO: 6803 - DNA, 14 bp, Artificial sequence
  synthetic sequence
actcggacggacta

SEQ ID NO: 6804 - DNA, 14 bp, Artificial sequence
  synthetic sequence
ccttgacgaaaaac

SEQ ID NO: 6805 - DNA, 14 bp, Artificial sequence
  synthetic sequence
gccgtgatcggccg

SEQ ID NO: 6806 - DNA, 14 bp, Artificial sequence
  synthetic sequence
aataaccaagtcgg

SEQ ID NO: 6807 - DNA, 14 bp, Artificial sequence
  synthetic sequence
ccctgcgtaggcac

SEQ ID NO: 6808 - DNA, 14 bp, Artificial sequence
  synthetic sequence
ctaggacagcgggt

SEQ ID NO: 6809 - DNA, 14 bp, Artificial sequence
  synthetic sequence
agccggttaggcca

SEQ ID NO: 6810 - DNA, 14 bp, Artificial sequence
  synthetic sequence
aactatgggcggca

SEQ ID NO: 6811 - DNA, 14 bp, Artificial sequence
  synthetic sequence
atgaggaaagggct

SEQ ID NO: 6812 - DNA, 14 bp, Artificial sequence
  synthetic sequence
cgatagatgcgaca

SEQ ID NO: 6813 - DNA, 14 bp, Artificial sequence
  synthetic sequence
ctgaacactacccc

SEQ ID NO: 6814 - DNA, 14 bp, Artificial sequence
  synthetic sequence
tgaaacacggtgaa

SEQ ID NO: 6815 - DNA, 14 bp, Artificial sequence
  synthetic sequence
aatatggaaccagc

SEQ ID NO: 6816 - DNA, 14 bp, Artificial sequence
  synthetic sequence
cagtaaggaaggtc

SEQ ID NO: 6817 - DNA, 14 bp, Artificial sequence
  synthetic sequence
taacccggtccgag

SEQ ID NO: 6818 - DNA, 14 bp, Artificial sequence
  synthetic sequence
ctgccgtacgggcc

SEQ ID NO: 6819 - DNA, 14 bp, Artificial sequence
  synthetic sequence
gtgaggacgggtaa

SEQ ID NO: 6820 - DNA, 14 bp, Artificial sequence
  synthetic sequence
cagcctcagcagat

SEQ ID NO: 6821 - DNA, 14 bp, Artificial sequence
  synthetic sequence
cactcagcctccgc

SEQ ID NO: 6822 - DNA, 14 bp, Artificial sequence
  synthetic sequence
tgaaaaggtacgac

SEQ ID NO: 6823 - DNA, 14 bp, Artificial sequence
  synthetic sequence
gggtccccactgga

SEQ ID NO: 6824 - DNA, 14 bp, Artificial sequence
  synthetic sequence
cacaacgcgcatgt

SEQ ID NO: 6825 - DNA, 14 bp, Artificial sequence
  synthetic sequence
acgatggcgcgcta

SEQ ID NO: 6826 - DNA, 14 bp, Artificial sequence
  synthetic sequence
gtagcgtagacgcg

SEQ ID NO: 6827 - DNA, 14 bp, Artificial sequence
  synthetic sequence
ccaccacagataat

SEQ ID NO: 6828 - DNA, 14 bp, Artificial sequence
  synthetic sequence
cgacgtggtagaaa

SEQ ID NO: 6829 - DNA, 14 bp, Artificial sequence
  synthetic sequence
gcgcacgcatgctg

SEQ ID NO: 6830 - DNA, 14 bp, Artificial sequence
  synthetic sequence
cgttagcggcagcc

SEQ ID NO: 6831 - DNA, 14 bp, Artificial sequence
  synthetic sequence
taggatcgccacca

SEQ ID NO: 6832 - DNA, 14 bp, Artificial sequence
  synthetic sequence
tcagcccgacctcg

SEQ ID NO: 6833 - DNA, 14 bp, Artificial sequence
  synthetic sequence
cgaaacgagttcgg

SEQ ID NO: 6834 - DNA, 14 bp, Artificial sequence
  synthetic sequence
ccccgtcctccaac

SEQ ID NO: 6835 - DNA, 14 bp, Artificial sequence
  synthetic sequence
ggtgacgtgaaacc

SEQ ID NO: 6836 - DNA, 14 bp, Artificial sequence
  synthetic sequence
atctacacaaggac

SEQ ID NO: 6837 - DNA, 14 bp, Artificial sequence
  synthetic sequence
agcgaaatgtcggg

SEQ ID NO: 6838 - DNA, 14 bp, Artificial sequence
  synthetic sequence
tctgccgataacag

SEQ ID NO: 6839 - DNA, 14 bp, Artificial sequence
  synthetic sequence
gagcaatctgctgg

SEQ ID NO: 6840 - DNA, 14 bp, Artificial sequence
  synthetic sequence
acctgtatcaaggc

SEQ ID NO: 6841 - DNA, 14 bp, Artificial sequence
  synthetic sequence
actttgaccccgaa

SEQ ID NO: 6842 - DNA, 14 bp, Artificial sequence
  synthetic sequence
tcggccagatggtg

SEQ ID NO: 6843 - DNA, 14 bp, Artificial sequence
  synthetic sequence
tcctgataaaggga

SEQ ID NO: 6844 - DNA, 14 bp, Artificial sequence
  synthetic sequence
acgaggcagtcttc

SEQ ID NO: 6845 - DNA, 14 bp, Artificial sequence
  synthetic sequence
aacgattggctaga

SEQ ID NO: 6846 - DNA, 14 bp, Artificial sequence
  synthetic sequence
tagctgcccatgaa

SEQ ID NO: 6847 - DNA, 14 bp, Artificial sequence
  synthetic sequence
tagcaaatctcccg

SEQ ID NO: 6848 - DNA, 14 bp, Artificial sequence
  synthetic sequence
agtagcattcgacg

SEQ ID NO: 6849 - DNA, 14 bp, Artificial sequence
  synthetic sequence
agctggtacaatag

SEQ ID NO: 6850 - DNA, 14 bp, Artificial sequence
  synthetic sequence
tcgcattagcgggc

SEQ ID NO: 6851 - DNA, 14 bp, Artificial sequence
  synthetic sequence
gaaggatttgaagg

SEQ ID NO: 6852 - DNA, 14 bp, Artificial sequence
  synthetic sequence
ccgctcgggtagtg

SEQ ID NO: 6853 - DNA, 14 bp, Artificial sequence
  synthetic sequence
tctccaacaataac

SEQ ID NO: 6854 - DNA, 14 bp, Artificial sequence
  synthetic sequence
ggatgtgcggtcca

SEQ ID NO: 6855 - DNA, 14 bp, Artificial sequence
  synthetic sequence
aaagagtacaactt

SEQ ID NO: 6856 - DNA, 14 bp, Artificial sequence
  synthetic sequence
gcttatacacgagg

SEQ ID NO: 6857 - DNA, 14 bp, Artificial sequence
  synthetic sequence
agatcaactagaat

SEQ ID NO: 6858 - DNA, 14 bp, Artificial sequence
  synthetic sequence
cgtgcttgcgcaaa

SEQ ID NO: 6859 - DNA, 14 bp, Artificial sequence
  synthetic sequence
ctcaagtgccccta

SEQ ID NO: 6860 - DNA, 14 bp, Artificial sequence
  synthetic sequence
gtgcaacgcttggg

SEQ ID NO: 6861 - DNA, 14 bp, Artificial sequence
  synthetic sequence
tcccacagcattga

SEQ ID NO: 6862 - DNA, 14 bp, Artificial sequence
  synthetic sequence
gaatagacgattca

SEQ ID NO: 6863 - DNA, 14 bp, Artificial sequence
  synthetic sequence
atgcccagcattag

SEQ ID NO: 6864 - DNA, 14 bp, Artificial sequence
  synthetic sequence
ctaagtcggaatcg

SEQ ID NO: 6865 - DNA, 14 bp, Artificial sequence
  synthetic sequence
tccagttaacccgg

SEQ ID NO: 6866 - DNA, 14 bp, Artificial sequence
  synthetic sequence
ataggagcgaatat

SEQ ID NO: 6867 - DNA, 14 bp, Artificial sequence
  synthetic sequence
tcgccgtgcctgga

SEQ ID NO: 6868 - DNA, 14 bp, Artificial sequence
  synthetic sequence
caccgtccggttga

SEQ ID NO: 6869 - DNA, 14 bp, Artificial sequence
  synthetic sequence
gttctcgaccaacg

SEQ ID NO: 6870 - DNA, 14 bp, Artificial sequence
  synthetic sequence
ctaatccaaccgtc

SEQ ID NO: 6871 - DNA, 14 bp, Artificial sequence
  synthetic sequence
aaataacatgcact

SEQ ID NO: 6872 - DNA, 14 bp, Artificial sequence
  synthetic sequence
ggataggggttaaa

SEQ ID NO: 6873 - DNA, 14 bp, Artificial sequence
  synthetic sequence
caccttgagaatac

SEQ ID NO: 6874 - DNA, 14 bp, Artificial sequence
  synthetic sequence
tggactaactcgca

SEQ ID NO: 6875 - DNA, 14 bp, Artificial sequence
  synthetic sequence
gcgagttgtgcgca

SEQ ID NO: 6876 - DNA, 14 bp, Artificial sequence
  synthetic sequence
ggccatcgtgggat

SEQ ID NO: 6877 - DNA, 14 bp, Artificial sequence
  synthetic sequence
gctgagaattgagg

SEQ ID NO: 6878 - DNA, 14 bp, Artificial sequence
  synthetic sequence
gcagatttaagacg

SEQ ID NO: 6879 - DNA, 14 bp, Artificial sequence
  synthetic sequence
agacattcaagtgg

SEQ ID NO: 6880 - DNA, 14 bp, Artificial sequence
  synthetic sequence
taacttgaccagca

SEQ ID NO: 6881 - DNA, 14 bp, Artificial sequence
  synthetic sequence
agaatatccctgga

SEQ ID NO: 6882 - DNA, 14 bp, Artificial sequence
  synthetic sequence
ccacaacctactct

SEQ ID NO: 6883 - DNA, 14 bp, Artificial sequence
  synthetic sequence
attcgccctaacag

SEQ ID NO: 6884 - DNA, 14 bp, Artificial sequence
  synthetic sequence
ggatgccacatcat

SEQ ID NO: 6885 - DNA, 14 bp, Artificial sequence
  synthetic sequence
agagtaaatcacgt

SEQ ID NO: 6886 - DNA, 14 bp, Artificial sequence
  synthetic sequence
atagtgtcaagggg

SEQ ID NO: 6887 - DNA, 14 bp, Artificial sequence
  synthetic sequence
gacttcggaagatc

SEQ ID NO: 6888 - DNA, 14 bp, Artificial sequence
  synthetic sequence
catctaacgcatga

SEQ ID NO: 6889 - DNA, 14 bp, Artificial sequence
  synthetic sequence
taactagcaccagt

SEQ ID NO: 6890 - DNA, 14 bp, Artificial sequence
  synthetic sequence
ctaagcaccgcttc

SEQ ID NO: 6891 - DNA, 14 bp, Artificial sequence
  synthetic sequence
acagactgataggt

SEQ ID NO: 6892 - DNA, 14 bp, Artificial sequence
  synthetic sequence
aagtcagctcctaa

SEQ ID NO: 6893 - DNA, 14 bp, Artificial sequence
  synthetic sequence
gactcccacacatt

SEQ ID NO: 6894 - DNA, 14 bp, Artificial sequence
  synthetic sequence
gtacatgtaccgaa

SEQ ID NO: 6895 - DNA, 14 bp, Artificial sequence
  synthetic sequence
ggtcggctagtaca

SEQ ID NO: 6896 - DNA, 14 bp, Artificial sequence
  synthetic sequence
tgatgcggacggat

SEQ ID NO: 6897 - DNA, 14 bp, Artificial sequence
  synthetic sequence
aaacaagtaactct

SEQ ID NO: 6898 - DNA, 14 bp, Artificial sequence
  synthetic sequence
aaatttccgacagc

SEQ ID NO: 6899 - DNA, 14 bp, Artificial sequence
  synthetic sequence
gaattgataggccc

SEQ ID NO: 6900 - DNA, 14 bp, Artificial sequence
  synthetic sequence
caacacaatggatt

SEQ ID NO: 6901 - DNA, 14 bp, Artificial sequence
  synthetic sequence
cacttggaacgtac

SEQ ID NO: 6902 - DNA, 14 bp, Artificial sequence
  synthetic sequence
gagttgacctaccc

SEQ ID NO: 6903 - DNA, 14 bp, Artificial sequence
  synthetic sequence
gggccaccttatgc

SEQ ID NO: 6904 - DNA, 14 bp, Artificial sequence
  synthetic sequence
ttgaccaaaatggg

SEQ ID NO: 6905 - DNA, 14 bp, Artificial sequence
  synthetic sequence
acggtgcgataaat

SEQ ID NO: 6906 - DNA, 14 bp, Artificial sequence
  synthetic sequence
cagtgcataggggt

SEQ ID NO: 6907 - DNA, 14 bp, Artificial sequence
  synthetic sequence
ggcacggtgctcat

SEQ ID NO: 6908 - DNA, 14 bp, Artificial sequence
  synthetic sequence
cagtgaagtccctg

SEQ ID NO: 6909 - DNA, 14 bp, Artificial sequence
  synthetic sequence
ttccggtgcaaaag

SEQ ID NO: 6910 - DNA, 14 bp, Artificial sequence
  synthetic sequence
gcgtctggacaact

SEQ ID NO: 6911 - DNA, 14 bp, Artificial sequence
  synthetic sequence
cggaccatcgggtt

SEQ ID NO: 6912 - DNA, 14 bp, Artificial sequence
  synthetic sequence
catttcagccgcac

SEQ ID NO: 6913 - DNA, 14 bp, Artificial sequence
  synthetic sequence
catcgcgctgatga

SEQ ID NO: 6914 - DNA, 14 bp, Artificial sequence
  synthetic sequence
gtgatggccacggt

SEQ ID NO: 6915 - DNA, 14 bp, Artificial sequence
  synthetic sequence
gatacgcgtgctca

SEQ ID NO: 6916 - DNA, 14 bp, Artificial sequence
  synthetic sequence
tctggtaggcccgc

SEQ ID NO: 6917 - DNA, 14 bp, Artificial sequence
  synthetic sequence
tctaagaaaatcgc

SEQ ID NO: 6918 - DNA, 14 bp, Artificial sequence
  synthetic sequence
cggacggaggttct

SEQ ID NO: 6919 - DNA, 14 bp, Artificial sequence
  synthetic sequence
ggctcacctcgtgg

SEQ ID NO: 6920 - DNA, 14 bp, Artificial sequence
  synthetic sequence
gatgtcatcaaagg

SEQ ID NO: 6921 - DNA, 14 bp, Artificial sequence
  synthetic sequence
atacgtccagaagt

SEQ ID NO: 6922 - DNA, 14 bp, Artificial sequence
  synthetic sequence
cgcagcttagccta

SEQ ID NO: 6923 - DNA, 14 bp, Artificial sequence
  synthetic sequence
acgtagggtagata

SEQ ID NO: 6924 - DNA, 14 bp, Artificial sequence
  synthetic sequence
tgggaacgtcaggt

SEQ ID NO: 6925 - DNA, 14 bp, Artificial sequence
  synthetic sequence
gtgggcgtgcaatc

SEQ ID NO: 6926 - DNA, 14 bp, Artificial sequence
  synthetic sequence
acgccacttagcta

SEQ ID NO: 6927 - DNA, 14 bp, Artificial sequence
  synthetic sequence
gcccttgcaacgta

SEQ ID NO: 6928 - DNA, 14 bp, Artificial sequence
  synthetic sequence
cttaccacctagcc

SEQ ID NO: 6929 - DNA, 14 bp, Artificial sequence
  synthetic sequence
gtctgctagccaac

SEQ ID NO: 6930 - DNA, 14 bp, Artificial sequence
  synthetic sequence
cggcgtccctgtaa

SEQ ID NO: 6931 - DNA, 14 bp, Artificial sequence
  synthetic sequence
cgcctgactgccat

SEQ ID NO: 6932 - DNA, 14 bp, Artificial sequence
  synthetic sequence
ggagggtcaaactt

SEQ ID NO: 6933 - DNA, 14 bp, Artificial sequence
  synthetic sequence
accgattctggccg

SEQ ID NO: 6934 - DNA, 14 bp, Artificial sequence
  synthetic sequence
actcgcacattcga

SEQ ID NO: 6935 - DNA, 14 bp, Artificial sequence
  synthetic sequence
ccgcctagctaaat

SEQ ID NO: 6936 - DNA, 14 bp, Artificial sequence
  synthetic sequence
tgtctccacacaag

SEQ ID NO: 6937 - DNA, 14 bp, Artificial sequence
  synthetic sequence
gcgtgctgcactag

SEQ ID NO: 6938 - DNA, 14 bp, Artificial sequence
  synthetic sequence
cattaacacacatg

SEQ ID NO: 6939 - DNA, 14 bp, Artificial sequence
  synthetic sequence
aggcccttaatgca

SEQ ID NO: 6940 - DNA, 14 bp, Artificial sequence
  synthetic sequence
ctgcacgcactaat

SEQ ID NO: 6941 - DNA, 14 bp, Artificial sequence
  synthetic sequence
tcgaaatgcggtag

SEQ ID NO: 6942 - DNA, 14 bp, Artificial sequence
  synthetic sequence
cccagacctgcctt

SEQ ID NO: 6943 - DNA, 14 bp, Artificial sequence
  synthetic sequence
tgatatcgacaggg

SEQ ID NO: 6944 - DNA, 14 bp, Artificial sequence
  synthetic sequence
tgtacaacgcactc

SEQ ID NO: 6945 - DNA, 14 bp, Artificial sequence
  synthetic sequence
atcatgatcagcaa

SEQ ID NO: 6946 - DNA, 14 bp, Artificial sequence
  synthetic sequence
tgctgactcggcgg

SEQ ID NO: 6947 - DNA, 14 bp, Artificial sequence
  synthetic sequence
acacctggtccatc

SEQ ID NO: 6948 - DNA, 14 bp, Artificial sequence
  synthetic sequence
ttaaggcaaaaatc

SEQ ID NO: 6949 - DNA, 14 bp, Artificial sequence
  synthetic sequence
aatgttacgcggac

SEQ ID NO: 6950 - DNA, 14 bp, Artificial sequence
  synthetic sequence
taagattacggcac

SEQ ID NO: 6951 - DNA, 14 bp, Artificial sequence
  synthetic sequence
cagaaagattatac

SEQ ID NO: 6952 - DNA, 14 bp, Artificial sequence
  synthetic sequence
ggattagataaggc

SEQ ID NO: 6953 - DNA, 14 bp, Artificial sequence
  synthetic sequence
gcttcgggtccggg

SEQ ID NO: 6954 - DNA, 14 bp, Artificial sequence
  synthetic sequence
cgtactgctacagg

SEQ ID NO: 6955 - DNA, 14 bp, Artificial sequence
  synthetic sequence
atggcctggaaata

SEQ ID NO: 6956 - DNA, 14 bp, Artificial sequence
  synthetic sequence
tgacggaattaaac

SEQ ID NO: 6957 - DNA, 14 bp, Artificial sequence
  synthetic sequence
agccgtagcttaaa

SEQ ID NO: 6958 - DNA, 14 bp, Artificial sequence
  synthetic sequence
aagtccgtcgcatc

SEQ ID NO: 6959 - DNA, 14 bp, Artificial sequence
  synthetic sequence
tgccgagttcgaac

SEQ ID NO: 6960 - DNA, 14 bp, Artificial sequence
  synthetic sequence
aggcctcagattga

SEQ ID NO: 6961 - DNA, 14 bp, Artificial sequence
  synthetic sequence
aaagtcgatggagt

SEQ ID NO: 6962 - DNA, 14 bp, Artificial sequence
  synthetic sequence
ggcctacttagaga

SEQ ID NO: 6963 - DNA, 14 bp, Artificial sequence
  synthetic sequence
gcatctaatcaggg

SEQ ID NO: 6964 - DNA, 14 bp, Artificial sequence
  synthetic sequence
aagattcatagagg

SEQ ID NO: 6965 - DNA, 14 bp, Artificial sequence
  synthetic sequence
acttcacgccgcgt

SEQ ID NO: 6966 - DNA, 14 bp, Artificial sequence
  synthetic sequence
gcgaggactttgca

SEQ ID NO: 6967 - DNA, 14 bp, Artificial sequence
  synthetic sequence
cttgcccatgagag

SEQ ID NO: 6968 - DNA, 14 bp, Artificial sequence
  synthetic sequence
agcctctgcgtcca

SEQ ID NO: 6969 - DNA, 14 bp, Artificial sequence
  synthetic sequence
cttataacccggga

SEQ ID NO: 6970 - DNA, 14 bp, Artificial sequence
  synthetic sequence
gactgcttggagag

SEQ ID NO: 6971 - DNA, 14 bp, Artificial sequence
  synthetic sequence
ggttcccaaatacc

SEQ ID NO: 6972 - DNA, 14 bp, Artificial sequence
  synthetic sequence
cctgcagtgacagt

SEQ ID NO: 6973 - DNA, 14 bp, Artificial sequence
  synthetic sequence
ccaatcgcgaatta

SEQ ID NO: 6974 - DNA, 14 bp, Artificial sequence
  synthetic sequence
cggccataatgtca

SEQ ID NO: 6975 - DNA, 14 bp, Artificial sequence
  synthetic sequence
actaacctgggata

SEQ ID NO: 6976 - DNA, 14 bp, Artificial sequence
  synthetic sequence
aatgcacttcggaa

SEQ ID NO: 6977 - DNA, 14 bp, Artificial sequence
  synthetic sequence
gagtgagccatgtg

SEQ ID NO: 6978 - DNA, 14 bp, Artificial sequence
  synthetic sequence
ctcaccgtatccac

SEQ ID NO: 6979 - DNA, 14 bp, Artificial sequence
  synthetic sequence
aaacgctcatgtga

SEQ ID NO: 6980 - DNA, 14 bp, Artificial sequence
  synthetic sequence
agctaataagcgtg

SEQ ID NO: 6981 - DNA, 14 bp, Artificial sequence
  synthetic sequence
tgaaaagggtgtga

SEQ ID NO: 6982 - DNA, 14 bp, Artificial sequence
  synthetic sequence
aagattaacctgag

SEQ ID NO: 6983 - DNA, 14 bp, Artificial sequence
  synthetic sequence
ggcaacttcatacc

SEQ ID NO: 6984 - DNA, 14 bp, Artificial sequence
  synthetic sequence
gctgcacgtacact

SEQ ID NO: 6985 - DNA, 14 bp, Artificial sequence
  synthetic sequence
tcgtgggatcaccc

SEQ ID NO: 6986 - DNA, 14 bp, Artificial sequence
  synthetic sequence
gaacggatcgtgtg

SEQ ID NO: 6987 - DNA, 14 bp, Artificial sequence
  synthetic sequence
gacctcattgaccg

SEQ ID NO: 6988 - DNA, 14 bp, Artificial sequence
  synthetic sequence
gagcgtgtgacgtg

SEQ ID NO: 6989 - DNA, 14 bp, Artificial sequence
  synthetic sequence
ccagagaatatggt

SEQ ID NO: 6990 - DNA, 14 bp, Artificial sequence
  synthetic sequence
gtcaagatgcagat

SEQ ID NO: 6991 - DNA, 14 bp, Artificial sequence
  synthetic sequence
tctcgtgggacaag

SEQ ID NO: 6992 - DNA, 14 bp, Artificial sequence
  synthetic sequence
agtttgcgacagaa

SEQ ID NO: 6993 - DNA, 14 bp, Artificial sequence
  synthetic sequence
agcaagctgggctt

SEQ ID NO: 6994 - DNA, 14 bp, Artificial sequence
  synthetic sequence
aattagggtaaccg

SEQ ID NO: 6995 - DNA, 14 bp, Artificial sequence
  synthetic sequence
tttggacggaggcg

SEQ ID NO: 6996 - DNA, 14 bp, Artificial sequence
  synthetic sequence
ccttgagacagtag

SEQ ID NO: 6997 - DNA, 14 bp, Artificial sequence
  synthetic sequence
acactagttggaga

SEQ ID NO: 6998 - DNA, 14 bp, Artificial sequence
  synthetic sequence
tcgcgtctaaacgg

SEQ ID NO: 6999 - DNA, 14 bp, Artificial sequence
  synthetic sequence
ctcgagctataccg

SEQ ID NO: 7000 - DNA, 14 bp, Artificial sequence
  synthetic sequence
ggaggataattaag

SEQ ID NO: 7001 - DNA, 14 bp, Artificial sequence
  synthetic sequence
aaggttcctgccag

SEQ ID NO: 7002 - DNA, 14 bp, Artificial sequence
  synthetic sequence
aaactatgcatagg

SEQ ID NO: 7003 - DNA, 14 bp, Artificial sequence
  synthetic sequence
tcgcccataaaggt

SEQ ID NO: 7004 - DNA, 14 bp, Artificial sequence
  synthetic sequence
agtggctggtaccg

SEQ ID NO: 7005 - DNA, 14 bp, Artificial sequence
  synthetic sequence
tggcgtaagagata

SEQ ID NO: 7006 - DNA, 14 bp, Artificial sequence
  synthetic sequence
cttagcacatcccg

SEQ ID NO: 7007 - DNA, 14 bp, Artificial sequence
  synthetic sequence
caaatgccggttag

SEQ ID NO: 7008 - DNA, 14 bp, Artificial sequence
  synthetic sequence
ccacctgactctgg

SEQ ID NO: 7009 - DNA, 14 bp, Artificial sequence
  synthetic sequence
ctgcttaaccggca

SEQ ID NO: 7010 - DNA, 14 bp, Artificial sequence
  synthetic sequence
tgggtggtagacgc

SEQ ID NO: 7011 - DNA, 14 bp, Artificial sequence
  synthetic sequence
tccgcttagacgcc

SEQ ID NO: 7012 - DNA, 14 bp, Artificial sequence
  synthetic sequence
gcgattcgcctcac

SEQ ID NO: 7013 - DNA, 14 bp, Artificial sequence
  synthetic sequence
cggcctacttcacc

SEQ ID NO: 7014 - DNA, 14 bp, Artificial sequence
  synthetic sequence
atcggtcactcaca

SEQ ID NO: 7015 - DNA, 14 bp, Artificial sequence
  synthetic sequence
ccacacttggtaga

SEQ ID NO: 7016 - DNA, 14 bp, Artificial sequence
  synthetic sequence
tccagactgacata

SEQ ID NO: 7017 - DNA, 14 bp, Artificial sequence
  synthetic sequence
cggagcagttctcc

SEQ ID NO: 7018 - DNA, 14 bp, Artificial sequence
  synthetic sequence
acgtacgtctcggc

SEQ ID NO: 7019 - DNA, 14 bp, Artificial sequence
  synthetic sequence
gatgatgggtcgaa

SEQ ID NO: 7020 - DNA, 14 bp, Artificial sequence
  synthetic sequence
cacccgtacagatt

SEQ ID NO: 7021 - DNA, 14 bp, Artificial sequence
  synthetic sequence
agatagtctgcggc

SEQ ID NO: 7022 - DNA, 14 bp, Artificial sequence
  synthetic sequence
ttcacccaatgagc

SEQ ID NO: 7023 - DNA, 14 bp, Artificial sequence
  synthetic sequence
gcaccgaatattac

SEQ ID NO: 7024 - DNA, 14 bp, Artificial sequence
  synthetic sequence
ggaaccccgttcta

SEQ ID NO: 7025 - DNA, 14 bp, Artificial sequence
  synthetic sequence
cactaggacggttg

SEQ ID NO: 7026 - DNA, 14 bp, Artificial sequence
  synthetic sequence
cagccccaatttga

SEQ ID NO: 7027 - DNA, 14 bp, Artificial sequence
  synthetic sequence
ttaatgacccaaga

SEQ ID NO: 7028 - DNA, 14 bp, Artificial sequence
  synthetic sequence
acccacattcaatg

SEQ ID NO: 7029 - DNA, 14 bp, Artificial sequence
  synthetic sequence
ggcgaataggctat

SEQ ID NO: 7030 - DNA, 14 bp, Artificial sequence
  synthetic sequence
caagtcccacttga

SEQ ID NO: 7031 - DNA, 14 bp, Artificial sequence
  synthetic sequence
cgatcggttgcgcc

SEQ ID NO: 7032 - DNA, 14 bp, Artificial sequence
  synthetic sequence
gtgtaacagtgcca

SEQ ID NO: 7033 - DNA, 14 bp, Artificial sequence
  synthetic sequence
tcgcgcaacttggc

SEQ ID NO: 7034 - DNA, 14 bp, Artificial sequence
  synthetic sequence
taggtcccgtccac

SEQ ID NO: 7035 - DNA, 14 bp, Artificial sequence
  synthetic sequence
ttccgtggagggac

SEQ ID NO: 7036 - DNA, 14 bp, Artificial sequence
  synthetic sequence
gcttgccaggagct

SEQ ID NO: 7037 - DNA, 14 bp, Artificial sequence
  synthetic sequence
aatcctatcgcgcg

SEQ ID NO: 7038 - DNA, 14 bp, Artificial sequence
  synthetic sequence
gggtcctaatccca

SEQ ID NO: 7039 - DNA, 14 bp, Artificial sequence
  synthetic sequence
tctacagggtaaag

SEQ ID NO: 7040 - DNA, 14 bp, Artificial sequence
  synthetic sequence
aatgcccagtgcta

SEQ ID NO: 7041 - DNA, 14 bp, Artificial sequence
  synthetic sequence
agcccttgaccggt

SEQ ID NO: 7042 - DNA, 14 bp, Artificial sequence
  synthetic sequence
agtggtcacatacc

SEQ ID NO: 7043 - DNA, 14 bp, Artificial sequence
  synthetic sequence
ctgaggaaatcgta

SEQ ID NO: 7044 - DNA, 14 bp, Artificial sequence
  synthetic sequence
cccgctcggtagtc

SEQ ID NO: 7045 - DNA, 14 bp, Artificial sequence
  synthetic sequence
cacgcgaactctgt

SEQ ID NO: 7046 - DNA, 14 bp, Artificial sequence
  synthetic sequence
ccaactgagatgta

SEQ ID NO: 7047 - DNA, 14 bp, Artificial sequence
  synthetic sequence
ggcgagtgcgtagt

SEQ ID NO: 7048 - DNA, 14 bp, Artificial sequence
  synthetic sequence
agagataattgacg

SEQ ID NO: 7049 - DNA, 14 bp, Artificial sequence
  synthetic sequence
gccatcctagtaca

SEQ ID NO: 7050 - DNA, 14 bp, Artificial sequence
  synthetic sequence
ccggctattcgccg

SEQ ID NO: 7051 - DNA, 14 bp, Artificial sequence
  synthetic sequence
caggtggggtccct

SEQ ID NO: 7052 - DNA, 14 bp, Artificial sequence
  synthetic sequence
tacaactaacctca

SEQ ID NO: 7053 - DNA, 14 bp, Artificial sequence
  synthetic sequence
tgggagattgggcg

SEQ ID NO: 7054 - DNA, 14 bp, Artificial sequence
  synthetic sequence
taccaataacgaat

SEQ ID NO: 7055 - DNA, 14 bp, Artificial sequence
  synthetic sequence
gatggaaggctgct

SEQ ID NO: 7056 - DNA, 14 bp, Artificial sequence
  synthetic sequence
gaacctctcgaaat

SEQ ID NO: 7057 - DNA, 14 bp, Artificial sequence
  synthetic sequence
atgtgaacaacctg

SEQ ID NO: 7058 - DNA, 14 bp, Artificial sequence
  synthetic sequence
cccggattcaggtg

SEQ ID NO: 7059 - DNA, 14 bp, Artificial sequence
  synthetic sequence
aaaccccaggttct

SEQ ID NO: 7060 - DNA, 14 bp, Artificial sequence
  synthetic sequence
cggcctgactactc

SEQ ID NO: 7061 - DNA, 14 bp, Artificial sequence
  synthetic sequence
ggcttcggggtcac

SEQ ID NO: 7062 - DNA, 14 bp, Artificial sequence
  synthetic sequence
aacgattccgaatc

SEQ ID NO: 7063 - DNA, 14 bp, Artificial sequence
  synthetic sequence
tggtacgatagaac

SEQ ID NO: 7064 - DNA, 14 bp, Artificial sequence
  synthetic sequence
gaatcctagatccg

SEQ ID NO: 7065 - DNA, 14 bp, Artificial sequence
  synthetic sequence
agaaccatttaggg

SEQ ID NO: 7066 - DNA, 14 bp, Artificial sequence
  synthetic sequence
gtacgataacctaa

SEQ ID NO: 7067 - DNA, 14 bp, Artificial sequence
  synthetic sequence
gcgtaaatgcaatg

SEQ ID NO: 7068 - DNA, 14 bp, Artificial sequence
  synthetic sequence
tagctaaatacaaa

SEQ ID NO: 7069 - DNA, 14 bp, Artificial sequence
  synthetic sequence
ccgcgttacctccg

SEQ ID NO: 7070 - DNA, 14 bp, Artificial sequence
  synthetic sequence
ccggtacagtgtca

SEQ ID NO: 7071 - DNA, 14 bp, Artificial sequence
  synthetic sequence
ttcaaacgacaaat

SEQ ID NO: 7072 - DNA, 14 bp, Artificial sequence
  synthetic sequence
tgcggttgacagga

SEQ ID NO: 7073 - DNA, 14 bp, Artificial sequence
  synthetic sequence
actccctaaaaaat

SEQ ID NO: 7074 - DNA, 14 bp, Artificial sequence
  synthetic sequence
ccggtgagctctcg

SEQ ID NO: 7075 - DNA, 14 bp, Artificial sequence
  synthetic sequence
tcgagatccaatgc

SEQ ID NO: 7076 - DNA, 14 bp, Artificial sequence
  synthetic sequence
aacgcgtgtcgggt

SEQ ID NO: 7077 - DNA, 14 bp, Artificial sequence
  synthetic sequence
ccgaccttgatcgc

SEQ ID NO: 7078 - DNA, 14 bp, Artificial sequence
  synthetic sequence
ggctgctatacgcc

SEQ ID NO: 7079 - DNA, 14 bp, Artificial sequence
  synthetic sequence
agacctcgaatgct

SEQ ID NO: 7080 - DNA, 14 bp, Artificial sequence
  synthetic sequence
atggagacaggtgt

SEQ ID NO: 7081 - DNA, 14 bp, Artificial sequence
  synthetic sequence
ccttgacgtgcgaa

SEQ ID NO: 7082 - DNA, 14 bp, Artificial sequence
  synthetic sequence
cgccgtcttccggg

SEQ ID NO: 7083 - DNA, 14 bp, Artificial sequence
  synthetic sequence
cgatacacgtatca

SEQ ID NO: 7084 - DNA, 14 bp, Artificial sequence
  synthetic sequence
caggaacttgagat

SEQ ID NO: 7085 - DNA, 14 bp, Artificial sequence
  synthetic sequence
gaggttagcgtgcg

SEQ ID NO: 7086 - DNA, 14 bp, Artificial sequence
  synthetic sequence
cagtacggctacct

SEQ ID NO: 7087 - DNA, 14 bp, Artificial sequence
  synthetic sequence
aaccaggctctctg

SEQ ID NO: 7088 - DNA, 14 bp, Artificial sequence
  synthetic sequence
aagtcaaacatagt

SEQ ID NO: 7089 - DNA, 14 bp, Artificial sequence
  synthetic sequence
gcagactttcagca

SEQ ID NO: 7090 - DNA, 14 bp, Artificial sequence
  synthetic sequence
gtagctcagaatga

SEQ ID NO: 7091 - DNA, 14 bp, Artificial sequence
  synthetic sequence
gaataactatcgcc

SEQ ID NO: 7092 - DNA, 14 bp, Artificial sequence
  synthetic sequence
tcaagtaggccgct

SEQ ID NO: 7093 - DNA, 14 bp, Artificial sequence
  synthetic sequence
aggcatggtcgact

SEQ ID NO: 7094 - DNA, 14 bp, Artificial sequence
  synthetic sequence
caacgtgtagcatc

SEQ ID NO: 7095 - DNA, 14 bp, Artificial sequence
  synthetic sequence
cgtgggtactcacc

SEQ ID NO: 7096 - DNA, 14 bp, Artificial sequence
  synthetic sequence
atcttgcagggaac

SEQ ID NO: 7097 - DNA, 14 bp, Artificial sequence
  synthetic sequence
cggaatcatgctac

SEQ ID NO: 7098 - DNA, 14 bp, Artificial sequence
  synthetic sequence
attcgacaatcgcc

SEQ ID NO: 7099 - DNA, 14 bp, Artificial sequence
  synthetic sequence
gatttcgcagcagg

SEQ ID NO: 7100 - DNA, 14 bp, Artificial sequence
  synthetic sequence
ttggcaggcggatg

SEQ ID NO: 7101 - DNA, 14 bp, Artificial sequence
  synthetic sequence
atgtcccacgatcc

SEQ ID NO: 7102 - DNA, 14 bp, Artificial sequence
  synthetic sequence
tcgaacgatccctc

SEQ ID NO: 7103 - DNA, 14 bp, Artificial sequence
  synthetic sequence
gcggacacacttat

SEQ ID NO: 7104 - DNA, 14 bp, Artificial sequence
  synthetic sequence
actattggcgcggg

SEQ ID NO: 7105 - DNA, 14 bp, Artificial sequence
  synthetic sequence
ggatccacatatgg

SEQ ID NO: 7106 - DNA, 14 bp, Artificial sequence
  synthetic sequence
cagttggcactaaa

SEQ ID NO: 7107 - DNA, 14 bp, Artificial sequence
  synthetic sequence
tcgcctgcgctaag

SEQ ID NO: 7108 - DNA, 14 bp, Artificial sequence
  synthetic sequence
tcgccgagcgttac

SEQ ID NO: 7109 - DNA, 14 bp, Artificial sequence
  synthetic sequence
ttgaacaaaacatc

SEQ ID NO: 7110 - DNA, 14 bp, Artificial sequence
  synthetic sequence
ccgtcggcttacga

SEQ ID NO: 7111 - DNA, 14 bp, Artificial sequence
  synthetic sequence
gttcaaacataagg

SEQ ID NO: 7112 - DNA, 14 bp, Artificial sequence
  synthetic sequence
actgcaacctggct

SEQ ID NO: 7113 - DNA, 14 bp, Artificial sequence
  synthetic sequence
gcggtcggccttga

SEQ ID NO: 7114 - DNA, 14 bp, Artificial sequence
  synthetic sequence
aaacactaggtgtc

SEQ ID NO: 7115 - DNA, 14 bp, Artificial sequence
  synthetic sequence
gcggttagtcaagc

SEQ ID NO: 7116 - DNA, 14 bp, Artificial sequence
  synthetic sequence
tgcgaacattaaaa

SEQ ID NO: 7117 - DNA, 14 bp, Artificial sequence
  synthetic sequence
taaagaagatgtcc

SEQ ID NO: 7118 - DNA, 14 bp, Artificial sequence
  synthetic sequence
ggtggcgaatgcta

SEQ ID NO: 7119 - DNA, 14 bp, Artificial sequence
  synthetic sequence
cacgtctgggtccc

SEQ ID NO: 7120 - DNA, 14 bp, Artificial sequence
  synthetic sequence
gacgcgcttgaata

SEQ ID NO: 7121 - DNA, 14 bp, Artificial sequence
  synthetic sequence
agtcggctctccgg

SEQ ID NO: 7122 - DNA, 14 bp, Artificial sequence
  synthetic sequence
gagcttactaaaga

SEQ ID NO: 7123 - DNA, 14 bp, Artificial sequence
  synthetic sequence
atggctagtgcgcg

SEQ ID NO: 7124 - DNA, 14 bp, Artificial sequence
  synthetic sequence
actacaggcgcatt

SEQ ID NO: 7125 - DNA, 14 bp, Artificial sequence
  synthetic sequence
tacgaggtactgca

SEQ ID NO: 7126 - DNA, 14 bp, Artificial sequence
  synthetic sequence
tgtgccgaatcgag

SEQ ID NO: 7127 - DNA, 14 bp, Artificial sequence
  synthetic sequence
gtaccgatgggctg

SEQ ID NO: 7128 - DNA, 14 bp, Artificial sequence
  synthetic sequence
gtccagtactccca

SEQ ID NO: 7129 - DNA, 14 bp, Artificial sequence
  synthetic sequence
aggcgactacagtt

SEQ ID NO: 7130 - DNA, 14 bp, Artificial sequence
  synthetic sequence
atcagggtgcgctc

SEQ ID NO: 7131 - DNA, 14 bp, Artificial sequence
  synthetic sequence
ggaaattgaagcgt

SEQ ID NO: 7132 - DNA, 14 bp, Artificial sequence
  synthetic sequence
gagataaggctaat

SEQ ID NO: 7133 - DNA, 14 bp, Artificial sequence
  synthetic sequence
tttagagccgaccg

SEQ ID NO: 7134 - DNA, 14 bp, Artificial sequence
  synthetic sequence
gttcgcgaccgggt

SEQ ID NO: 7135 - DNA, 14 bp, Artificial sequence
  synthetic sequence
catcgtggaagagt

SEQ ID NO: 7136 - DNA, 14 bp, Artificial sequence
  synthetic sequence
aagtagttgccgca

SEQ ID NO: 7137 - DNA, 14 bp, Artificial sequence
  synthetic sequence
atggctgcataagc

SEQ ID NO: 7138 - DNA, 14 bp, Artificial sequence
  synthetic sequence
gatggggctataca

SEQ ID NO: 7139 - DNA, 14 bp, Artificial sequence
  synthetic sequence
aggatcttcggcac

SEQ ID NO: 7140 - DNA, 14 bp, Artificial sequence
  synthetic sequence
ctacctccgctcag

SEQ ID NO: 7141 - DNA, 14 bp, Artificial sequence
  synthetic sequence
cgatgattgacgca

SEQ ID NO: 7142 - DNA, 14 bp, Artificial sequence
  synthetic sequence
aactaaactcgact

SEQ ID NO: 7143 - DNA, 14 bp, Artificial sequence
  synthetic sequence
gactcgtccctcac

SEQ ID NO: 7144 - DNA, 14 bp, Artificial sequence
  synthetic sequence
ggtcacagagaatt

SEQ ID NO: 7145 - DNA, 14 bp, Artificial sequence
  synthetic sequence
cgggatacactgtg

SEQ ID NO: 7146 - DNA, 14 bp, Artificial sequence
  synthetic sequence
tcgccaacgtatca

SEQ ID NO: 7147 - DNA, 14 bp, Artificial sequence
  synthetic sequence
ttaggccgaactgc

SEQ ID NO: 7148 - DNA, 14 bp, Artificial sequence
  synthetic sequence
tcacaaggtaggct

SEQ ID NO: 7149 - DNA, 14 bp, Artificial sequence
  synthetic sequence
taccggcaacttaa

SEQ ID NO: 7150 - DNA, 14 bp, Artificial sequence
  synthetic sequence
acagcttaatcagg

SEQ ID NO: 7151 - DNA, 14 bp, Artificial sequence
  synthetic sequence
agtctaaagtaaac

SEQ ID NO: 7152 - DNA, 14 bp, Artificial sequence
  synthetic sequence
ccccgtgcccttcc

SEQ ID NO: 7153 - DNA, 14 bp, Artificial sequence
  synthetic sequence
ttagaaacgccata

SEQ ID NO: 7154 - DNA, 14 bp, Artificial sequence
  synthetic sequence
gcacatacataaat

SEQ ID NO: 7155 - DNA, 14 bp, Artificial sequence
  synthetic sequence
tatccgcgtgcagg

SEQ ID NO: 7156 - DNA, 14 bp, Artificial sequence
  synthetic sequence
ccgcgtccgtactg

SEQ ID NO: 7157 - DNA, 14 bp, Artificial sequence
  synthetic sequence
tgagaatcctaagg

SEQ ID NO: 7158 - DNA, 14 bp, Artificial sequence
  synthetic sequence
tcgacatatccagc

SEQ ID NO: 7159 - DNA, 14 bp, Artificial sequence
  synthetic sequence
gttctccggaggcc

SEQ ID NO: 7160 - DNA, 14 bp, Artificial sequence
  synthetic sequence
ggacggatacggtt

SEQ ID NO: 7161 - DNA, 14 bp, Artificial sequence
  synthetic sequence
agatcacacagttg

SEQ ID NO: 7162 - DNA, 14 bp, Artificial sequence
  synthetic sequence
gggggtttcggagg

SEQ ID NO: 7163 - DNA, 14 bp, Artificial sequence
  synthetic sequence
cacagctaattagg

SEQ ID NO: 7164 - DNA, 14 bp, Artificial sequence
  synthetic sequence
cgaatgaccgtgtg

SEQ ID NO: 7165 - DNA, 14 bp, Artificial sequence
  synthetic sequence
tacctgtcaggagg

SEQ ID NO: 7166 - DNA, 14 bp, Artificial sequence
  synthetic sequence
tgaccgtcagacgt

SEQ ID NO: 7167 - DNA, 14 bp, Artificial sequence
  synthetic sequence
gcggaattcatgaa

SEQ ID NO: 7168 - DNA, 14 bp, Artificial sequence
  synthetic sequence
ctggacccctctac

SEQ ID NO: 7169 - DNA, 14 bp, Artificial sequence
  synthetic sequence
atggggaccgcatt

SEQ ID NO: 7170 - DNA, 14 bp, Artificial sequence
  synthetic sequence
taactcgtcgaggg

SEQ ID NO: 7171 - DNA, 14 bp, Artificial sequence
  synthetic sequence
cctggggagtatgc

SEQ ID NO: 7172 - DNA, 14 bp, Artificial sequence
  synthetic sequence
aggtcctcgcctcg

SEQ ID NO: 7173 - DNA, 14 bp, Artificial sequence
  synthetic sequence
gttacgcgacagta

SEQ ID NO: 7174 - DNA, 14 bp, Artificial sequence
  synthetic sequence
taggcaggtctcac

SEQ ID NO: 7175 - DNA, 14 bp, Artificial sequence
  synthetic sequence
ttcaagacgtcgcc

SEQ ID NO: 7176 - DNA, 14 bp, Artificial sequence
  synthetic sequence
ggaatcgaagtgta

SEQ ID NO: 7177 - DNA, 14 bp, Artificial sequence
  synthetic sequence
acagcgtcgcctat

SEQ ID NO: 7178 - DNA, 14 bp, Artificial sequence
  synthetic sequence
gctaggaatactcg

SEQ ID NO: 7179 - DNA, 14 bp, Artificial sequence
  synthetic sequence
ggcataggggcctt

SEQ ID NO: 7180 - DNA, 14 bp, Artificial sequence
  synthetic sequence
agctttaacgagcg

SEQ ID NO: 7181 - DNA, 14 bp, Artificial sequence
  synthetic sequence
cggtcgcatacact

SEQ ID NO: 7182 - DNA, 14 bp, Artificial sequence
  synthetic sequence
agtgcttggaagac

SEQ ID NO: 7183 - DNA, 14 bp, Artificial sequence
  synthetic sequence
gtaatgatagaggg

SEQ ID NO: 7184 - DNA, 14 bp, Artificial sequence
  synthetic sequence
gtcacgcctatgac

SEQ ID NO: 7185 - DNA, 14 bp, Artificial sequence
  synthetic sequence
gaagcctgttcggg

SEQ ID NO: 7186 - DNA, 14 bp, Artificial sequence
  synthetic sequence
ctgcgctcgtggcg

SEQ ID NO: 7187 - DNA, 14 bp, Artificial sequence
  synthetic sequence
agatgtcctgcgcg

SEQ ID NO: 7188 - DNA, 14 bp, Artificial sequence
  synthetic sequence
aaaccaaccttact

SEQ ID NO: 7189 - DNA, 14 bp, Artificial sequence
  synthetic sequence
agcgatgtatccga

SEQ ID NO: 7190 - DNA, 14 bp, Artificial sequence
  synthetic sequence
agagctcccgtctc

SEQ ID NO: 7191 - DNA, 14 bp, Artificial sequence
  synthetic sequence
aattgcctaccccc

SEQ ID NO: 7192 - DNA, 14 bp, Artificial sequence
  synthetic sequence
aatgcaaggtctca

SEQ ID NO: 7193 - DNA, 14 bp, Artificial sequence
  synthetic sequence
taatcaggctaccg

SEQ ID NO: 7194 - DNA, 14 bp, Artificial sequence
  synthetic sequence
ggagaaagtttcgc

SEQ ID NO: 7195 - DNA, 14 bp, Artificial sequence
  synthetic sequence
cagggttgatgcaa

SEQ ID NO: 7196 - DNA, 14 bp, Artificial sequence
  synthetic sequence
tataagcaaacaat

SEQ ID NO: 7197 - DNA, 14 bp, Artificial sequence
  synthetic sequence
ggcaggttacagta

SEQ ID NO: 7198 - DNA, 14 bp, Artificial sequence
  synthetic sequence
gggaggtgacctct

SEQ ID NO: 7199 - DNA, 14 bp, Artificial sequence
  synthetic sequence
cggtgaacttaccg

SEQ ID NO: 7200 - DNA, 14 bp, Artificial sequence
  synthetic sequence
atcgatctcagacg

SEQ ID NO: 7201 - DNA, 14 bp, Artificial sequence
  synthetic sequence
caccctgccctagt

SEQ ID NO: 7202 - DNA, 14 bp, Artificial sequence
  synthetic sequence
aacgtctaccggta

SEQ ID NO: 7203 - DNA, 14 bp, Artificial sequence
  synthetic sequence
cgttaagccaagtc

SEQ ID NO: 7204 - DNA, 14 bp, Artificial sequence
  synthetic sequence
cgatgcatctcagg

SEQ ID NO: 7205 - DNA, 14 bp, Artificial sequence
  synthetic sequence
gtagcggagctcct

SEQ ID NO: 7206 - DNA, 14 bp, Artificial sequence
  synthetic sequence
tccaaccgaagtat

SEQ ID NO: 7207 - DNA, 14 bp, Artificial sequence
  synthetic sequence
gacgttatggcggc

SEQ ID NO: 7208 - DNA, 14 bp, Artificial sequence
  synthetic sequence
gcggtctagcggct

SEQ ID NO: 7209 - DNA, 14 bp, Artificial sequence
  synthetic sequence
cggcagtgtcgtca

SEQ ID NO: 7210 - DNA, 14 bp, Artificial sequence
  synthetic sequence
taataaccggagtg

SEQ ID NO: 7211 - DNA, 14 bp, Artificial sequence
  synthetic sequence
tgtccgggtccaac

SEQ ID NO: 7212 - DNA, 14 bp, Artificial sequence
  synthetic sequence
ctcaaatcgcctgg

SEQ ID NO: 7213 - DNA, 14 bp, Artificial sequence
  synthetic sequence
tacgactaacaatc

SEQ ID NO: 7214 - DNA, 14 bp, Artificial sequence
  synthetic sequence
gtagctgggaggtg

SEQ ID NO: 7215 - DNA, 14 bp, Artificial sequence
  synthetic sequence
cccgttgtcaaacc

SEQ ID NO: 7216 - DNA, 14 bp, Artificial sequence
  synthetic sequence
ccggacgatcttcg

SEQ ID NO: 7217 - DNA, 14 bp, Artificial sequence
  synthetic sequence
gagctacttgcgag

SEQ ID NO: 7218 - DNA, 14 bp, Artificial sequence
  synthetic sequence
gtatcgaatcccac

SEQ ID NO: 7219 - DNA, 14 bp, Artificial sequence
  synthetic sequence
tcgtggacgcgtgc

SEQ ID NO: 7220 - DNA, 14 bp, Artificial sequence
  synthetic sequence
taaacctacacatc

SEQ ID NO: 7221 - DNA, 14 bp, Artificial sequence
  synthetic sequence
cgatgatgaagggt

SEQ ID NO: 7222 - DNA, 14 bp, Artificial sequence
  synthetic sequence
ataatgctaggaaa

SEQ ID NO: 7223 - DNA, 14 bp, Artificial sequence
  synthetic sequence
taggatccgtacgg

SEQ ID NO: 7224 - DNA, 14 bp, Artificial sequence
  synthetic sequence
tgccgctgacctgg

SEQ ID NO: 7225 - DNA, 14 bp, Artificial sequence
  synthetic sequence
tacccgtggcgtgc

SEQ ID NO: 7226 - DNA, 14 bp, Artificial sequence
  synthetic sequence
cacagttacccgct

SEQ ID NO: 7227 - DNA, 14 bp, Artificial sequence
  synthetic sequence
tgtctagagagcag

SEQ ID NO: 7228 - DNA, 14 bp, Artificial sequence
  synthetic sequence
agattcacagtcgg

SEQ ID NO: 7229 - DNA, 14 bp, Artificial sequence
  synthetic sequence
gatgaactccaatg

SEQ ID NO: 7230 - DNA, 14 bp, Artificial sequence
  synthetic sequence
gcggataagtgctg

SEQ ID NO: 7231 - DNA, 14 bp, Artificial sequence
  synthetic sequence
gcctggatggccgt

SEQ ID NO: 7232 - DNA, 14 bp, Artificial sequence
  synthetic sequence
taacaaagtatcaa

SEQ ID NO: 7233 - DNA, 14 bp, Artificial sequence
  synthetic sequence
atacttagcccggg

SEQ ID NO: 7234 - DNA, 14 bp, Artificial sequence
  synthetic sequence
agtatgaagcgctc

SEQ ID NO: 7235 - DNA, 14 bp, Artificial sequence
  synthetic sequence
cactcaggatacat

SEQ ID NO: 7236 - DNA, 14 bp, Artificial sequence
  synthetic sequence
cggtcataactcag

SEQ ID NO: 7237 - DNA, 14 bp, Artificial sequence
  synthetic sequence
tacagtaacgggta

SEQ ID NO: 7238 - DNA, 14 bp, Artificial sequence
  synthetic sequence
taggggtcgatagc

SEQ ID NO: 7239 - DNA, 14 bp, Artificial sequence
  synthetic sequence
tccagagcggtatc

SEQ ID NO: 7240 - DNA, 14 bp, Artificial sequence
  synthetic sequence
gaacaaacatattc

SEQ ID NO: 7241 - DNA, 14 bp, Artificial sequence
  synthetic sequence
gccctagcgtgcct

SEQ ID NO: 7242 - DNA, 14 bp, Artificial sequence
  synthetic sequence
cttaccacatgaga

SEQ ID NO: 7243 - DNA, 14 bp, Artificial sequence
  synthetic sequence
aaccgcttagtcag

SEQ ID NO: 7244 - DNA, 14 bp, Artificial sequence
  synthetic sequence
aacgtccgtgcatc

SEQ ID NO: 7245 - DNA, 14 bp, Artificial sequence
  synthetic sequence
ttgaaacaccgtaa

SEQ ID NO: 7246 - DNA, 14 bp, Artificial sequence
  synthetic sequence
tgagataataggaa

SEQ ID NO: 7247 - DNA, 14 bp, Artificial sequence
  synthetic sequence
cttagacaaaggtc

SEQ ID NO: 7248 - DNA, 14 bp, Artificial sequence
  synthetic sequence
cccgtcagattagg

SEQ ID NO: 7249 - DNA, 14 bp, Artificial sequence
  synthetic sequence
cgagggtacgtaat

SEQ ID NO: 7250 - DNA, 14 bp, Artificial sequence
  synthetic sequence
cacgtctggcggat

SEQ ID NO: 7251 - DNA, 14 bp, Artificial sequence
  synthetic sequence
cgtggtgagtgaag

SEQ ID NO: 7252 - DNA, 14 bp, Artificial sequence
  synthetic sequence
attgagaatggaac

SEQ ID NO: 7253 - DNA, 14 bp, Artificial sequence
  synthetic sequence
ttacgaagtcacag

SEQ ID NO: 7254 - DNA, 14 bp, Artificial sequence
  synthetic sequence
tctgacgtaccgcc

SEQ ID NO: 7255 - DNA, 14 bp, Artificial sequence
  synthetic sequence
agggacttgatccc

SEQ ID NO: 7256 - DNA, 14 bp, Artificial sequence
  synthetic sequence
agtagtccggtagc

SEQ ID NO: 7257 - DNA, 14 bp, Artificial sequence
  synthetic sequence
gcttgcccgaaata

SEQ ID NO: 7258 - DNA, 14 bp, Artificial sequence
  synthetic sequence
tagattcagcaccg

SEQ ID NO: 7259 - DNA, 14 bp, Artificial sequence
  synthetic sequence
ctgtcatgcggcgg

SEQ ID NO: 7260 - DNA, 14 bp, Artificial sequence
  synthetic sequence
agactagtgataaa

SEQ ID NO: 7261 - DNA, 14 bp, Artificial sequence
  synthetic sequence
cagtctaaatcgcg

SEQ ID NO: 7262 - DNA, 14 bp, Artificial sequence
  synthetic sequence
tgaggttggacgag

SEQ ID NO: 7263 - DNA, 14 bp, Artificial sequence
  synthetic sequence
tcattcacggggac

SEQ ID NO: 7264 - DNA, 14 bp, Artificial sequence
  synthetic sequence
caggtaagccattg

SEQ ID NO: 7265 - DNA, 14 bp, Artificial sequence
  synthetic sequence
cggtgctagtgagc

SEQ ID NO: 7266 - DNA, 14 bp, Artificial sequence
  synthetic sequence
atgcacacgatata

SEQ ID NO: 7267 - DNA, 14 bp, Artificial sequence
  synthetic sequence
gattgcgtaccgag

SEQ ID NO: 7268 - DNA, 14 bp, Artificial sequence
  synthetic sequence
tcatctgaaccggt

SEQ ID NO: 7269 - DNA, 14 bp, Artificial sequence
  synthetic sequence
cgctactgctgtaa

SEQ ID NO: 7270 - DNA, 14 bp, Artificial sequence
  synthetic sequence
taagtgacagttgg

SEQ ID NO: 7271 - DNA, 14 bp, Artificial sequence
  synthetic sequence
cagaggtgaattta

SEQ ID NO: 7272 - DNA, 14 bp, Artificial sequence
  synthetic sequence
gcccctcattcgta

SEQ ID NO: 7273 - DNA, 14 bp, Artificial sequence
  synthetic sequence
ccctgctgatactg

SEQ ID NO: 7274 - DNA, 14 bp, Artificial sequence
  synthetic sequence
agttgtcggtggaa

SEQ ID NO: 7275 - DNA, 14 bp, Artificial sequence
  synthetic sequence
ggagagttgtgtgg

SEQ ID NO: 7276 - DNA, 14 bp, Artificial sequence
  synthetic sequence
tgccagccctgtct

SEQ ID NO: 7277 - DNA, 14 bp, Artificial sequence
  synthetic sequence
gatcattagactga

SEQ ID NO: 7278 - DNA, 14 bp, Artificial sequence
  synthetic sequence
gttgatacaacgtc

SEQ ID NO: 7279 - DNA, 14 bp, Artificial sequence
  synthetic sequence
agacgcggtcttta

SEQ ID NO: 7280 - DNA, 14 bp, Artificial sequence
  synthetic sequence
agctttagaatacc

SEQ ID NO: 7281 - DNA, 14 bp, Artificial sequence
  synthetic sequence
ttctgcccatagca

SEQ ID NO: 7282 - DNA, 14 bp, Artificial sequence
  synthetic sequence
acctgcctccgatt

SEQ ID NO: 7283 - DNA, 14 bp, Artificial sequence
  synthetic sequence
ctcgtcgcgaagtt

SEQ ID NO: 7284 - DNA, 14 bp, Artificial sequence
  synthetic sequence
agaagcttacttaa

SEQ ID NO: 7285 - DNA, 14 bp, Artificial sequence
  synthetic sequence
ttgctcgccaaagt

SEQ ID NO: 7286 - DNA, 14 bp, Artificial sequence
  synthetic sequence
gttcttacccgcaa

SEQ ID NO: 7287 - DNA, 14 bp, Artificial sequence
  synthetic sequence
tcttcataccagcc

SEQ ID NO: 7288 - DNA, 14 bp, Artificial sequence
  synthetic sequence
gagcgaattctagt

SEQ ID NO: 7289 - DNA, 14 bp, Artificial sequence
  synthetic sequence
aaggcgaatttgtc

SEQ ID NO: 7290 - DNA, 14 bp, Artificial sequence
  synthetic sequence
gaagtccgttaata

SEQ ID NO: 7291 - DNA, 14 bp, Artificial sequence
  synthetic sequence
atttgaccatgaaa

SEQ ID NO: 7292 - DNA, 14 bp, Artificial sequence
  synthetic sequence
tatacagtagtgca

SEQ ID NO: 7293 - DNA, 14 bp, Artificial sequence
  synthetic sequence
aatcatcactgctc

SEQ ID NO: 7294 - DNA, 14 bp, Artificial sequence
  synthetic sequence
gagacgggattttg

SEQ ID NO: 7295 - DNA, 14 bp, Artificial sequence
  synthetic sequence
gatagcttcggata

SEQ ID NO: 7296 - DNA, 14 bp, Artificial sequence
  synthetic sequence
tacggacgttgtaa

SEQ ID NO: 7297 - DNA, 14 bp, Artificial sequence
  synthetic sequence
tccagtccagggtt

SEQ ID NO: 7298 - DNA, 14 bp, Artificial sequence
  synthetic sequence
aataagactggttg

SEQ ID NO: 7299 - DNA, 14 bp, Artificial sequence
  synthetic sequence
agtgactcgcattc

SEQ ID NO: 7300 - DNA, 14 bp, Artificial sequence
  synthetic sequence
ctcccgcttcgcct

SEQ ID NO: 7301 - DNA, 14 bp, Artificial sequence
  synthetic sequence
ttggctgagcaaat

SEQ ID NO: 7302 - DNA, 14 bp, Artificial sequence
  synthetic sequence
tccccaccttgata

SEQ ID NO: 7303 - DNA, 14 bp, Artificial sequence
  synthetic sequence
aaggagtgttctcg

SEQ ID NO: 7304 - DNA, 14 bp, Artificial sequence
  synthetic sequence
acggtggcgtttaa

SEQ ID NO: 7305 - DNA, 14 bp, Artificial sequence
  synthetic sequence
cttcacatcggatg

SEQ ID NO: 7306 - DNA, 14 bp, Artificial sequence
  synthetic sequence
cttttcgcgggcac

SEQ ID NO: 7307 - DNA, 14 bp, Artificial sequence
  synthetic sequence
ttcggggtatccgg

SEQ ID NO: 7308 - DNA, 14 bp, Artificial sequence
  synthetic sequence
ctgcctgggttcaa

SEQ ID NO: 7309 - DNA, 14 bp, Artificial sequence
  synthetic sequence
ttgcctaaagctca

SEQ ID NO: 7310 - DNA, 14 bp, Artificial sequence
  synthetic sequence
acctagcattagat

SEQ ID NO: 7311 - DNA, 14 bp, Artificial sequence
  synthetic sequence
ccttggaaattgac

SEQ ID NO: 7312 - DNA, 14 bp, Artificial sequence
  synthetic sequence
gactcctgtgcgtc

SEQ ID NO: 7313 - DNA, 14 bp, Artificial sequence
  synthetic sequence
taatcaaacccatt

SEQ ID NO: 7314 - DNA, 14 bp, Artificial sequence
  synthetic sequence
aaatggtcctataa

SEQ ID NO: 7315 - DNA, 14 bp, Artificial sequence
  synthetic sequence
attctgggcctcac

SEQ ID NO: 7316 - DNA, 14 bp, Artificial sequence
  synthetic sequence
aatttccgaaaact

SEQ ID NO: 7317 - DNA, 14 bp, Artificial sequence
  synthetic sequence
acgctataggagtt

SEQ ID NO: 7318 - DNA, 14 bp, Artificial sequence
  synthetic sequence
taggaggaatttac

SEQ ID NO: 7319 - DNA, 14 bp, Artificial sequence
  synthetic sequence
ctgcaagcatatct

SEQ ID NO: 7320 - DNA, 14 bp, Artificial sequence
  synthetic sequence
tgggtcactgcctc

SEQ ID NO: 7321 - DNA, 14 bp, Artificial sequence
  synthetic sequence
ggacgacttcgttg

SEQ ID NO: 7322 - DNA, 14 bp, Artificial sequence
  synthetic sequence
gacactactctggt

SEQ ID NO: 7323 - DNA, 14 bp, Artificial sequence
  synthetic sequence
ccatgtcgacttac

SEQ ID NO: 7324 - DNA, 14 bp, Artificial sequence
  synthetic sequence
ccaggcctttgact

SEQ ID NO: 7325 - DNA, 14 bp, Artificial sequence
  synthetic sequence
atgcgctcgcgtgt

SEQ ID NO: 7326 - DNA, 14 bp, Artificial sequence
  synthetic sequence
gataactagtagtc

SEQ ID NO: 7327 - DNA, 14 bp, Artificial sequence
  synthetic sequence
ggatatctgggtgc

SEQ ID NO: 7328 - DNA, 14 bp, Artificial sequence
  synthetic sequence
gctccgctatagat

SEQ ID NO: 7329 - DNA, 14 bp, Artificial sequence
  synthetic sequence
cctctccataacgt

SEQ ID NO: 7330 - DNA, 14 bp, Artificial sequence
  synthetic sequence
acccgtcaagtctt

SEQ ID NO: 7331 - DNA, 14 bp, Artificial sequence
  synthetic sequence
actggtccgtgagt

SEQ ID NO: 7332 - DNA, 14 bp, Artificial sequence
  synthetic sequence
gtgcatgggtaact

SEQ ID NO: 7333 - DNA, 14 bp, Artificial sequence
  synthetic sequence
tcttgaactaacgg

SEQ ID NO: 7334 - DNA, 14 bp, Artificial sequence
  synthetic sequence
ctgcgctcttaaac

SEQ ID NO: 7335 - DNA, 14 bp, Artificial sequence
  synthetic sequence
tctcccaagatgtc

SEQ ID NO: 7336 - DNA, 14 bp, Artificial sequence
  synthetic sequence
attactaaccacat

SEQ ID NO: 7337 - DNA, 14 bp, Artificial sequence
  synthetic sequence
tttacaagcgatga

SEQ ID NO: 7338 - DNA, 14 bp, Artificial sequence
  synthetic sequence
tagtgttgcccgca

SEQ ID NO: 7339 - DNA, 14 bp, Artificial sequence
  synthetic sequence
tgaatggagcgtct

SEQ ID NO: 7340 - DNA, 14 bp, Artificial sequence
  synthetic sequence
atgatgttacccca

SEQ ID NO: 7341 - DNA, 14 bp, Artificial sequence
  synthetic sequence
tagaatttaaggaa

SEQ ID NO: 7342 - DNA, 14 bp, Artificial sequence
  synthetic sequence
tacgccatagtctg

SEQ ID NO: 7343 - DNA, 14 bp, Artificial sequence
  synthetic sequence
gcgttacccatata

SEQ ID NO: 7344 - DNA, 14 bp, Artificial sequence
  synthetic sequence
tagtccgccatcgt

SEQ ID NO: 7345 - DNA, 14 bp, Artificial sequence
  synthetic sequence
gtacacactttcgg

SEQ ID NO: 7346 - DNA, 14 bp, Artificial sequence
  synthetic sequence
tgggctttggaggg

SEQ ID NO: 7347 - DNA, 14 bp, Artificial sequence
  synthetic sequence
tatggcgttcaaag

SEQ ID NO: 7348 - DNA, 14 bp, Artificial sequence
  synthetic sequence
acgtcgctgactct

SEQ ID NO: 7349 - DNA, 14 bp, Artificial sequence
  synthetic sequence
ctacgtcctatgaa

SEQ ID NO: 7350 - DNA, 14 bp, Artificial sequence
  synthetic sequence
gtttctaggcaaac

SEQ ID NO: 7351 - DNA, 14 bp, Artificial sequence
  synthetic sequence
ttacattgccgaac

SEQ ID NO: 7352 - DNA, 14 bp, Artificial sequence
  synthetic sequence
gatcttacaccact

SEQ ID NO: 7353 - DNA, 14 bp, Artificial sequence
  synthetic sequence
ggataactcctact

SEQ ID NO: 7354 - DNA, 14 bp, Artificial sequence
  synthetic sequence
aaatattggacgtc

SEQ ID NO: 7355 - DNA, 14 bp, Artificial sequence
  synthetic sequence
cacgagattagtta

SEQ ID NO: 7356 - DNA, 14 bp, Artificial sequence
  synthetic sequence
gtctggcgatactc

SEQ ID NO: 7357 - DNA, 14 bp, Artificial sequence
  synthetic sequence
aagccagctgtttc

SEQ ID NO: 7358 - DNA, 14 bp, Artificial sequence
  synthetic sequence
ctccaaacttgtgc

SEQ ID NO: 7359 - DNA, 14 bp, Artificial sequence
  synthetic sequence
caacgcctcttcgt

SEQ ID NO: 7360 - DNA, 14 bp, Artificial sequence
  synthetic sequence
tcggatctaggcat

SEQ ID NO: 7361 - DNA, 14 bp, Artificial sequence
  synthetic sequence
gatggagtagtggt

SEQ ID NO: 7362 - DNA, 14 bp, Artificial sequence
  synthetic sequence
tccgtatggctcga

SEQ ID NO: 7363 - DNA, 14 bp, Artificial sequence
  synthetic sequence
tacttgctaaaaga

SEQ ID NO: 7364 - DNA, 14 bp, Artificial sequence
  synthetic sequence
gaccgggtttgtgc

SEQ ID NO: 7365 - DNA, 14 bp, Artificial sequence
  synthetic sequence
agcactttgcgtag

SEQ ID NO: 7366 - DNA, 14 bp, Artificial sequence
  synthetic sequence
aacttaatcagtag

SEQ ID NO: 7367 - DNA, 14 bp, Artificial sequence
  synthetic sequence
ctgttaactccacg

SEQ ID NO: 7368 - DNA, 14 bp, Artificial sequence
  synthetic sequence
ttaaggatatcaca

SEQ ID NO: 7369 - DNA, 14 bp, Artificial sequence
  synthetic sequence
attgtgcgccccgt

SEQ ID NO: 7370 - DNA, 14 bp, Artificial sequence
  synthetic sequence
caggcatgtttgcg

SEQ ID NO: 7371 - DNA, 14 bp, Artificial sequence
  synthetic sequence
caattcactaagat

SEQ ID NO: 7372 - DNA, 14 bp, Artificial sequence
  synthetic sequence
atttgcgaacgact

SEQ ID NO: 7373 - DNA, 14 bp, Artificial sequence
  synthetic sequence
aacttcatggataa

SEQ ID NO: 7374 - DNA, 14 bp, Artificial sequence
  synthetic sequence
ttaaggcacgatct

SEQ ID NO: 7375 - DNA, 14 bp, Artificial sequence
  synthetic sequence
gtagttacatgaga

SEQ ID NO: 7376 - DNA, 14 bp, Artificial sequence
  synthetic sequence
gcttcctctacgaa

SEQ ID NO: 7377 - DNA, 14 bp, Artificial sequence
  synthetic sequence
taagacggccttat

SEQ ID NO: 7378 - DNA, 14 bp, Artificial sequence
  synthetic sequence
tgagagggttctgc

SEQ ID NO: 7379 - DNA, 14 bp, Artificial sequence
  synthetic sequence
cttaacgaatagta

SEQ ID NO: 7380 - DNA, 14 bp, Artificial sequence
  synthetic sequence
catggttgtcgaac

SEQ ID NO: 7381 - DNA, 14 bp, Artificial sequence
  synthetic sequence
tatcggagaaagtt

SEQ ID NO: 7382 - DNA, 14 bp, Artificial sequence
  synthetic sequence
tacttacagctgag

SEQ ID NO: 7383 - DNA, 14 bp, Artificial sequence
  synthetic sequence
cgctttaccctacg

SEQ ID NO: 7384 - DNA, 14 bp, Artificial sequence
  synthetic sequence
cactgaggtatatc

SEQ ID NO: 7385 - DNA, 14 bp, Artificial sequence
  synthetic sequence
aaatgctattgaac

SEQ ID NO: 7386 - DNA, 14 bp, Artificial sequence
  synthetic sequence
atagccgtttgacg

SEQ ID NO: 7387 - DNA, 14 bp, Artificial sequence
  synthetic sequence
ctttcggaatacgg

SEQ ID NO: 7388 - DNA, 14 bp, Artificial sequence
  synthetic sequence
aggcttatggaaat

SEQ ID NO: 7389 - DNA, 14 bp, Artificial sequence
  synthetic sequence
ttgaggccgtaaat

SEQ ID NO: 7390 - DNA, 14 bp, Artificial sequence
  synthetic sequence
ggtgaaggattcct

SEQ ID NO: 7391 - DNA, 14 bp, Artificial sequence
  synthetic sequence
gagatctggttcag

SEQ ID NO: 7392 - DNA, 14 bp, Artificial sequence
  synthetic sequence
ttggttacgaacaa

SEQ ID NO: 7393 - DNA, 14 bp, Artificial sequence
  synthetic sequence
tgtaaggagatgct

SEQ ID NO: 7394 - DNA, 14 bp, Artificial sequence
  synthetic sequence
cgtcgttaacccat

SEQ ID NO: 7395 - DNA, 14 bp, Artificial sequence
  synthetic sequence
ttggtaaaactgga

SEQ ID NO: 7396 - DNA, 14 bp, Artificial sequence
  synthetic sequence
ctgtcaacttggga

SEQ ID NO: 7397 - DNA, 14 bp, Artificial sequence
  synthetic sequence
tgaatcctccatcc

SEQ ID NO: 7398 - DNA, 14 bp, Artificial sequence
  synthetic sequence
cggtgtgccgtgtc

SEQ ID NO: 7399 - DNA, 14 bp, Artificial sequence
  synthetic sequence
ggaacgggtattgt

SEQ ID NO: 7400 - DNA, 14 bp, Artificial sequence
  synthetic sequence
ttcgccctctacgg

SEQ ID NO: 7401 - DNA, 14 bp, Artificial sequence
  synthetic sequence
actaggtggcttca

SEQ ID NO: 7402 - DNA, 14 bp, Artificial sequence
  synthetic sequence
tctcagggcttcgg

SEQ ID NO: 7403 - DNA, 14 bp, Artificial sequence
  synthetic sequence
ctggtgccggtgtg

SEQ ID NO: 7404 - DNA, 14 bp, Artificial sequence
  synthetic sequence
acaaatagtgattc

SEQ ID NO: 7405 - DNA, 14 bp, Artificial sequence
  synthetic sequence
atcatcgtccatga

SEQ ID NO: 7406 - DNA, 14 bp, Artificial sequence
  synthetic sequence
aaacagattttccc

SEQ ID NO: 7407 - DNA, 14 bp, Artificial sequence
  synthetic sequence
tccaggggttctac

SEQ ID NO: 7408 - DNA, 14 bp, Artificial sequence
  synthetic sequence
ctaaaagtcagttg

SEQ ID NO: 7409 - DNA, 14 bp, Artificial sequence
  synthetic sequence
ttctcgagccaggt

SEQ ID NO: 7410 - DNA, 14 bp, Artificial sequence
  synthetic sequence
tggtgtggtggggc

SEQ ID NO: 7411 - DNA, 14 bp, Artificial sequence
  synthetic sequence
ggctattaatgggc

SEQ ID NO: 7412 - DNA, 14 bp, Artificial sequence
  synthetic sequence
agtgctagacttca

SEQ ID NO: 7413 - DNA, 14 bp, Artificial sequence
  synthetic sequence
ccaggttgatcatc

SEQ ID NO: 7414 - DNA, 14 bp, Artificial sequence
  synthetic sequence
ttcatccggaaata

SEQ ID NO: 7415 - DNA, 14 bp, Artificial sequence
  synthetic sequence
cctctatgctgcgc

SEQ ID NO: 7416 - DNA, 14 bp, Artificial sequence
  synthetic sequence
taacatctgcggtg

SEQ ID NO: 7417 - DNA, 14 bp, Artificial sequence
  synthetic sequence
ttactgtaggcgcc

SEQ ID NO: 7418 - DNA, 14 bp, Artificial sequence
  synthetic sequence
atatcgagttcacc

SEQ ID NO: 7419 - DNA, 14 bp, Artificial sequence
  synthetic sequence
tctcttaaacgcac

SEQ ID NO: 7420 - DNA, 14 bp, Artificial sequence
  synthetic sequence
ggcttttggagagc

SEQ ID NO: 7421 - DNA, 14 bp, Artificial sequence
  synthetic sequence
gtaagaatgcatct

SEQ ID NO: 7422 - DNA, 14 bp, Artificial sequence
  synthetic sequence
tgatgtacaaaatc

SEQ ID NO: 7423 - DNA, 14 bp, Artificial sequence
  synthetic sequence
cgggaagtattgat

SEQ ID NO: 7424 - DNA, 14 bp, Artificial sequence
  synthetic sequence
ttctcggggggctg

SEQ ID NO: 7425 - DNA, 14 bp, Artificial sequence
  synthetic sequence
tcaggattagatca

SEQ ID NO: 7426 - DNA, 14 bp, Artificial sequence
  synthetic sequence
tcagtgctgcgctg

SEQ ID NO: 7427 - DNA, 14 bp, Artificial sequence
  synthetic sequence
cgggactagttata

SEQ ID NO: 7428 - DNA, 14 bp, Artificial sequence
  synthetic sequence
atgtcccccttaaa

SEQ ID NO: 7429 - DNA, 14 bp, Artificial sequence
  synthetic sequence
tgccgatgtgacgt

SEQ ID NO: 7430 - DNA, 14 bp, Artificial sequence
  synthetic sequence
tgctaaatggcgct

SEQ ID NO: 7431 - DNA, 14 bp, Artificial sequence
  synthetic sequence
atccctaaaacttg

SEQ ID NO: 7432 - DNA, 14 bp, Artificial sequence
  synthetic sequence
ccagatacgttatc

SEQ ID NO: 7433 - DNA, 14 bp, Artificial sequence
  synthetic sequence
cggctataaaatgt

SEQ ID NO: 7434 - DNA, 14 bp, Artificial sequence
  synthetic sequence
ctgcgaatctaatc

SEQ ID NO: 7435 - DNA, 14 bp, Artificial sequence
  synthetic sequence
atacacattctaca

SEQ ID NO: 7436 - DNA, 14 bp, Artificial sequence
  synthetic sequence
tcctaggcttaaag

SEQ ID NO: 7437 - DNA, 14 bp, Artificial sequence
  synthetic sequence
gtatacaagtgtag

SEQ ID NO: 7438 - DNA, 14 bp, Artificial sequence
  synthetic sequence
agagtcatactagt

SEQ ID NO: 7439 - DNA, 14 bp, Artificial sequence
  synthetic sequence
tccctccattgggg

SEQ ID NO: 7440 - DNA, 14 bp, Artificial sequence
  synthetic sequence
ttgacattaccgag

SEQ ID NO: 7441 - DNA, 14 bp, Artificial sequence
  synthetic sequence
taagggtatgtcga

SEQ ID NO: 7442 - DNA, 14 bp, Artificial sequence
  synthetic sequence
atgtgcttgcacgc

SEQ ID NO: 7443 - DNA, 14 bp, Artificial sequence
  synthetic sequence
gctctagaacttag

SEQ ID NO: 7444 - DNA, 14 bp, Artificial sequence
  synthetic sequence
tactaccctggtgg

SEQ ID NO: 7445 - DNA, 14 bp, Artificial sequence
  synthetic sequence
taaattcacgaagt

SEQ ID NO: 7446 - DNA, 14 bp, Artificial sequence
  synthetic sequence
ccctgctggcttgg

SEQ ID NO: 7447 - DNA, 14 bp, Artificial sequence
  synthetic sequence
gggttcgccttgcg

SEQ ID NO: 7448 - DNA, 14 bp, Artificial sequence
  synthetic sequence
tgtctggctggagc

SEQ ID NO: 7449 - DNA, 14 bp, Artificial sequence
  synthetic sequence
acattctctggcgc

SEQ ID NO: 7450 - DNA, 14 bp, Artificial sequence
  synthetic sequence
gaagttactcacat

SEQ ID NO: 7451 - DNA, 14 bp, Artificial sequence
  synthetic sequence
gcgatttgatcccg

SEQ ID NO: 7452 - DNA, 14 bp, Artificial sequence
  synthetic sequence
ccataggtccattc

SEQ ID NO: 7453 - DNA, 14 bp, Artificial sequence
  synthetic sequence
atcgcagcttcata

SEQ ID NO: 7454 - DNA, 14 bp, Artificial sequence
  synthetic sequence
gtagctctcctgaa

SEQ ID NO: 7455 - DNA, 14 bp, Artificial sequence
  synthetic sequence
catgatggccctgt

SEQ ID NO: 7456 - DNA, 14 bp, Artificial sequence
  synthetic sequence
agtcgtttcaccaa

SEQ ID NO: 7457 - DNA, 14 bp, Artificial sequence
  synthetic sequence
tccaatcggtaggt

SEQ ID NO: 7458 - DNA, 14 bp, Artificial sequence
  synthetic sequence
agtcggtgtcatcc

SEQ ID NO: 7459 - DNA, 14 bp, Artificial sequence
  synthetic sequence
aggctttcagcata

SEQ ID NO: 7460 - DNA, 14 bp, Artificial sequence
  synthetic sequence
tttataagacgcag

SEQ ID NO: 7461 - DNA, 14 bp, Artificial sequence
  synthetic sequence
ctggcctctatgca

SEQ ID NO: 7462 - DNA, 14 bp, Artificial sequence
  synthetic sequence
gcgtttgcgggtcg

SEQ ID NO: 7463 - DNA, 14 bp, Artificial sequence
  synthetic sequence
ggattttcggaggc

SEQ ID NO: 7464 - DNA, 14 bp, Artificial sequence
  synthetic sequence
tgctggtatggaca

SEQ ID NO: 7465 - DNA, 14 bp, Artificial sequence
  synthetic sequence
gtttggacaataac

SEQ ID NO: 7466 - DNA, 14 bp, Artificial sequence
  synthetic sequence
gcggcatgcattgt

SEQ ID NO: 7467 - DNA, 14 bp, Artificial sequence
  synthetic sequence
ttcagtgccatgga

SEQ ID NO: 7468 - DNA, 14 bp, Artificial sequence
  synthetic sequence
gcagagtaatttca

SEQ ID NO: 7469 - DNA, 14 bp, Artificial sequence
  synthetic sequence
tctacaaacgtcat

SEQ ID NO: 7470 - DNA, 14 bp, Artificial sequence
  synthetic sequence
ctgccgacgaattt

SEQ ID NO: 7471 - DNA, 14 bp, Artificial sequence
  synthetic sequence
cttgcacggctaat

SEQ ID NO: 7472 - DNA, 14 bp, Artificial sequence
  synthetic sequence
acgtgtcccatgct

SEQ ID NO: 7473 - DNA, 14 bp, Artificial sequence
  synthetic sequence
tcatccaacaggtt

SEQ ID NO: 7474 - DNA, 14 bp, Artificial sequence
  synthetic sequence
actgtgaccctctg

SEQ ID NO: 7475 - DNA, 14 bp, Artificial sequence
  synthetic sequence
acggctttcgccta

SEQ ID NO: 7476 - DNA, 14 bp, Artificial sequence
  synthetic sequence
tgattatcgacagg

SEQ ID NO: 7477 - DNA, 14 bp, Artificial sequence
  synthetic sequence
cccaatatttacag

SEQ ID NO: 7478 - DNA, 14 bp, Artificial sequence
  synthetic sequence
gtcatgtacataag

SEQ ID NO: 7479 - DNA, 14 bp, Artificial sequence
  synthetic sequence
ccaccgactctttg

SEQ ID NO: 7480 - DNA, 14 bp, Artificial sequence
  synthetic sequence
cacctcgtcttggc

SEQ ID NO: 7481 - DNA, 14 bp, Artificial sequence
  synthetic sequence
agtagattgcagtc

SEQ ID NO: 7482 - DNA, 14 bp, Artificial sequence
  synthetic sequence
gtacgctccgtcta

SEQ ID NO: 7483 - DNA, 14 bp, Artificial sequence
  synthetic sequence
cgcgctgttcgcta

SEQ ID NO: 7484 - DNA, 14 bp, Artificial sequence
  synthetic sequence
ccccaggattgtct

SEQ ID NO: 7485 - DNA, 14 bp, Artificial sequence
  synthetic sequence
tctgacggtacatg

SEQ ID NO: 7486 - DNA, 14 bp, Artificial sequence
  synthetic sequence
gcctgaactttcgc

SEQ ID NO: 7487 - DNA, 14 bp, Artificial sequence
  synthetic sequence
cgcgtctataggtg

SEQ ID NO: 7488 - DNA, 14 bp, Artificial sequence
  synthetic sequence
aagaatggcttgct

SEQ ID NO: 7489 - DNA, 14 bp, Artificial sequence
  synthetic sequence
gtgagcaggccttt

SEQ ID NO: 7490 - DNA, 14 bp, Artificial sequence
  synthetic sequence
ctacttagtgcgcc

SEQ ID NO: 7491 - DNA, 14 bp, Artificial sequence
  synthetic sequence
acgtgtgacttaaa

SEQ ID NO: 7492 - DNA, 14 bp, Artificial sequence
  synthetic sequence
taactacattccgc

SEQ ID NO: 7493 - DNA, 14 bp, Artificial sequence
  synthetic sequence
ctgagccctgtgat

SEQ ID NO: 7494 - DNA, 14 bp, Artificial sequence
  synthetic sequence
catcggatgctcat

SEQ ID NO: 7495 - DNA, 14 bp, Artificial sequence
  synthetic sequence
cgtgtccctgggtc

SEQ ID NO: 7496 - DNA, 14 bp, Artificial sequence
  synthetic sequence
aatatgggtagatc

SEQ ID NO: 7497 - DNA, 14 bp, Artificial sequence
  synthetic sequence
gcggtgatgctcgt

SEQ ID NO: 7498 - DNA, 14 bp, Artificial sequence
  synthetic sequence
ggcctgctatatcc

SEQ ID NO: 7499 - DNA, 14 bp, Artificial sequence
  synthetic sequence
ttcgcacagagtta

SEQ ID NO: 7500 - DNA, 14 bp, Artificial sequence
  synthetic sequence
ttgacacctgagtg

SEQ ID NO: 7501 - DNA, 14 bp, Artificial sequence
  synthetic sequence
cacgctagtatgta

SEQ ID NO: 7502 - DNA, 14 bp, Artificial sequence
  synthetic sequence
aagtctcgtcggta

SEQ ID NO: 7503 - DNA, 14 bp, Artificial sequence
  synthetic sequence
gggtatccccctct

SEQ ID NO: 7504 - DNA, 14 bp, Artificial sequence
  synthetic sequence
tagttcaaaagatg

SEQ ID NO: 7505 - DNA, 14 bp, Artificial sequence
  synthetic sequence
caacaaattttgga

SEQ ID NO: 7506 - DNA, 14 bp, Artificial sequence
  synthetic sequence
gtggtgagatatgc

SEQ ID NO: 7507 - DNA, 14 bp, Artificial sequence
  synthetic sequence
gaaactgtcatgtc

SEQ ID NO: 7508 - DNA, 14 bp, Artificial sequence
  synthetic sequence
gtccgggatcgtat

SEQ ID NO: 7509 - DNA, 14 bp, Artificial sequence
  synthetic sequence
ggtgaagtgatgtg

SEQ ID NO: 7510 - DNA, 14 bp, Artificial sequence
  synthetic sequence
cacttcgagacctt

SEQ ID NO: 7511 - DNA, 14 bp, Artificial sequence
  synthetic sequence
ttatgggcgtgcca

SEQ ID NO: 7512 - DNA, 14 bp, Artificial sequence
  synthetic sequence
ctgaacgtgccttc

SEQ ID NO: 7513 - DNA, 14 bp, Artificial sequence
  synthetic sequence
catagtggcgaatt

SEQ ID NO: 7514 - DNA, 14 bp, Artificial sequence
  synthetic sequence
ccaatgctggtagt

SEQ ID NO: 7515 - DNA, 14 bp, Artificial sequence
  synthetic sequence
cgtttaagaggcat

SEQ ID NO: 7516 - DNA, 14 bp, Artificial sequence
  synthetic sequence
gcattctcggcgtg

SEQ ID NO: 7517 - DNA, 14 bp, Artificial sequence
  synthetic sequence
aagagcttactcct

SEQ ID NO: 7518 - DNA, 14 bp, Artificial sequence
  synthetic sequence
cccctttcgctcca

SEQ ID NO: 7519 - DNA, 14 bp, Artificial sequence
  synthetic sequence
gccactctgtgtgg

SEQ ID NO: 7520 - DNA, 14 bp, Artificial sequence
  synthetic sequence
gagggtataatgct

SEQ ID NO: 7521 - DNA, 14 bp, Artificial sequence
  synthetic sequence
caattgctcgatga

SEQ ID NO: 7522 - DNA, 14 bp, Artificial sequence
  synthetic sequence
taaccttcgagatg

SEQ ID NO: 7523 - DNA, 14 bp, Artificial sequence
  synthetic sequence
cggcatttacgctc

SEQ ID NO: 7524 - DNA, 14 bp, Artificial sequence
  synthetic sequence
gggttccgttgccc

SEQ ID NO: 7525 - DNA, 14 bp, Artificial sequence
  synthetic sequence
tgtagaggtcacta

SEQ ID NO: 7526 - DNA, 14 bp, Artificial sequence
  synthetic sequence
tgttgaaccgggtg

SEQ ID NO: 7527 - DNA, 14 bp, Artificial sequence
  synthetic sequence
gatctggagttgac

SEQ ID NO: 7528 - DNA, 14 bp, Artificial sequence
  synthetic sequence
ctggcgtgtgtagg

SEQ ID NO: 7529 - DNA, 14 bp, Artificial sequence
  synthetic sequence
tgcgtgcgtcggtc

SEQ ID NO: 7530 - DNA, 14 bp, Artificial sequence
  synthetic sequence
tgaccacaattgtg

SEQ ID NO: 7531 - DNA, 14 bp, Artificial sequence
  synthetic sequence
actccaatagctct

SEQ ID NO: 7532 - DNA, 14 bp, Artificial sequence
  synthetic sequence
cgtatcatcaatac

SEQ ID NO: 7533 - DNA, 14 bp, Artificial sequence
  synthetic sequence
cttgacgctacagt

SEQ ID NO: 7534 - DNA, 14 bp, Artificial sequence
  synthetic sequence
tgaggcttaaatag

SEQ ID NO: 7535 - DNA, 14 bp, Artificial sequence
  synthetic sequence
cttgaattgaagca

SEQ ID NO: 7536 - DNA, 14 bp, Artificial sequence
  synthetic sequence
gcagcacgtttcta

SEQ ID NO: 7537 - DNA, 14 bp, Artificial sequence
  synthetic sequence
gttgtgcccaaatc

SEQ ID NO: 7538 - DNA, 14 bp, Artificial sequence
  synthetic sequence
aggtcaccggtttg

SEQ ID NO: 7539 - DNA, 14 bp, Artificial sequence
  synthetic sequence
ggtaatgacgcgtt

SEQ ID NO: 7540 - DNA, 14 bp, Artificial sequence
  synthetic sequence
agcttaggcttccc

SEQ ID NO: 7541 - DNA, 14 bp, Artificial sequence
  synthetic sequence
aacgttagctatag

SEQ ID NO: 7542 - DNA, 14 bp, Artificial sequence
  synthetic sequence
aatgatagtcgctc

SEQ ID NO: 7543 - DNA, 14 bp, Artificial sequence
  synthetic sequence
gccacgttcgttac

SEQ ID NO: 7544 - DNA, 14 bp, Artificial sequence
  synthetic sequence
ggtcctcgcatctc

SEQ ID NO: 7545 - DNA, 14 bp, Artificial sequence
  synthetic sequence
tcctttacaccggc

SEQ ID NO: 7546 - DNA, 14 bp, Artificial sequence
  synthetic sequence
agtattctgagaaa

SEQ ID NO: 7547 - DNA, 14 bp, Artificial sequence
  synthetic sequence
gactcttcggatgg

SEQ ID NO: 7548 - DNA, 14 bp, Artificial sequence
  synthetic sequence
cgcgcatgattact

SEQ ID NO: 7549 - DNA, 14 bp, Artificial sequence
  synthetic sequence
ctgcggcttgctaa

SEQ ID NO: 7550 - DNA, 14 bp, Artificial sequence
  synthetic sequence
ctagaattagagtc

SEQ ID NO: 7551 - DNA, 14 bp, Artificial sequence
  synthetic sequence
agcgtctgttgagc

SEQ ID NO: 7552 - DNA, 14 bp, Artificial sequence
  synthetic sequence
tatcttagacaagg

SEQ ID NO: 7553 - DNA, 14 bp, Artificial sequence
  synthetic sequence
tatgcacccaatgt

SEQ ID NO: 7554 - DNA, 14 bp, Artificial sequence
  synthetic sequence
tgaagagaattgat

SEQ ID NO: 7555 - DNA, 14 bp, Artificial sequence
  synthetic sequence
tgcggtcgaacttg

SEQ ID NO: 7556 - DNA, 14 bp, Artificial sequence
  synthetic sequence
gatcttgaaggtgg

SEQ ID NO: 7557 - DNA, 14 bp, Artificial sequence
  synthetic sequence
cactatcatatccg

SEQ ID NO: 7558 - DNA, 14 bp, Artificial sequence
  synthetic sequence
ctgcacatttcgcg

SEQ ID NO: 7559 - DNA, 14 bp, Artificial sequence
  synthetic sequence
tcttaagggaactg

SEQ ID NO: 7560 - DNA, 14 bp, Artificial sequence
  synthetic sequence
tgggttccggacct

SEQ ID NO: 7561 - DNA, 14 bp, Artificial sequence
  synthetic sequence
tgtacggtgctacg

SEQ ID NO: 7562 - DNA, 14 bp, Artificial sequence
  synthetic sequence
atagcgtctaaact

SEQ ID NO: 7563 - DNA, 14 bp, Artificial sequence
  synthetic sequence
gagtgtattggcga

SEQ ID NO: 7564 - DNA, 14 bp, Artificial sequence
  synthetic sequence
gatgtactcctcaa

SEQ ID NO: 7565 - DNA, 14 bp, Artificial sequence
  synthetic sequence
ctgtcctcatccgg

SEQ ID NO: 7566 - DNA, 14 bp, Artificial sequence
  synthetic sequence
aaggaattgttcaa

SEQ ID NO: 7567 - DNA, 14 bp, Artificial sequence
  synthetic sequence
cgtttacactcccg

SEQ ID NO: 7568 - DNA, 14 bp, Artificial sequence
  synthetic sequence
atcggtagccttga

SEQ ID NO: 7569 - DNA, 14 bp, Artificial sequence
  synthetic sequence
agtagtcaacttgg

SEQ ID NO: 7570 - DNA, 14 bp, Artificial sequence
  synthetic sequence
tctctagagtacca

SEQ ID NO: 7571 - DNA, 14 bp, Artificial sequence
  synthetic sequence
tctgccatcgagtg

SEQ ID NO: 7572 - DNA, 14 bp, Artificial sequence
  synthetic sequence
ttaactcaggccta

SEQ ID NO: 7573 - DNA, 14 bp, Artificial sequence
  synthetic sequence
tagctggggagttg

SEQ ID NO: 7574 - DNA, 14 bp, Artificial sequence
  synthetic sequence
atccgtaatgcggt

SEQ ID NO: 7575 - DNA, 14 bp, Artificial sequence
  synthetic sequence
tatatgacgggtcc

SEQ ID NO: 7576 - DNA, 14 bp, Artificial sequence
  synthetic sequence
gatcagtgtacact

SEQ ID NO: 7577 - DNA, 14 bp, Artificial sequence
  synthetic sequence
tgagtaaactaatc

SEQ ID NO: 7578 - DNA, 14 bp, Artificial sequence
  synthetic sequence
ctcacctcgatcct

SEQ ID NO: 7579 - DNA, 14 bp, Artificial sequence
  synthetic sequence
acgttaatacctgc

SEQ ID NO: 7580 - DNA, 14 bp, Artificial sequence
  synthetic sequence
tcctaagtaatgcg

SEQ ID NO: 7581 - DNA, 14 bp, Artificial sequence
  synthetic sequence
tagtgcgcgactat

SEQ ID NO: 7582 - DNA, 14 bp, Artificial sequence
  synthetic sequence
tacgttcccagaat

SEQ ID NO: 7583 - DNA, 14 bp, Artificial sequence
  synthetic sequence
tccttggatgaagc

SEQ ID NO: 7584 - DNA, 14 bp, Artificial sequence
  synthetic sequence
atctccatacactg

SEQ ID NO: 7585 - DNA, 14 bp, Artificial sequence
  synthetic sequence
cggcctatgtgcat

SEQ ID NO: 7586 - DNA, 14 bp, Artificial sequence
  synthetic sequence
gatccctctgtgca

SEQ ID NO: 7587 - DNA, 14 bp, Artificial sequence
  synthetic sequence
agctttgaactagg

SEQ ID NO: 7588 - DNA, 14 bp, Artificial sequence
  synthetic sequence
tgcaagttgcgata

SEQ ID NO: 7589 - DNA, 14 bp, Artificial sequence
  synthetic sequence
tatcctgtcggggc

SEQ ID NO: 7590 - DNA, 14 bp, Artificial sequence
  synthetic sequence
taaaaactacactt

SEQ ID NO: 7591 - DNA, 14 bp, Artificial sequence
  synthetic sequence
ttggtacggcgtag

SEQ ID NO: 7592 - DNA, 14 bp, Artificial sequence
  synthetic sequence
gtagaagtcttagc

SEQ ID NO: 7593 - DNA, 14 bp, Artificial sequence
  synthetic sequence
cgatatcacgttaa

SEQ ID NO: 7594 - DNA, 14 bp, Artificial sequence
  synthetic sequence
attaggataggtga

SEQ ID NO: 7595 - DNA, 14 bp, Artificial sequence
  synthetic sequence
actgaccgatttac

SEQ ID NO: 7596 - DNA, 14 bp, Artificial sequence
  synthetic sequence
catagattgatccg

SEQ ID NO: 7597 - DNA, 14 bp, Artificial sequence
  synthetic sequence
ctcttgctcaagcc

SEQ ID NO: 7598 - DNA, 14 bp, Artificial sequence
  synthetic sequence
ctgcttccgtaagc

SEQ ID NO: 7599 - DNA, 14 bp, Artificial sequence
  synthetic sequence
tagtacactaataa

SEQ ID NO: 7600 - DNA, 14 bp, Artificial sequence
  synthetic sequence
catttggctaagcc

SEQ ID NO: 7601 - DNA, 14 bp, Artificial sequence
  synthetic sequence
ccgttactcgctag

SEQ ID NO: 7602 - DNA, 14 bp, Artificial sequence
  synthetic sequence
ctcggattgcagat

SEQ ID NO: 7603 - DNA, 14 bp, Artificial sequence
  synthetic sequence
ctgcctagtgggat

SEQ ID NO: 7604 - DNA, 14 bp, Artificial sequence
  synthetic sequence
cactttcgggcgat

SEQ ID NO: 7605 - DNA, 14 bp, Artificial sequence
  synthetic sequence
ccgtttggtgggca

SEQ ID NO: 7606 - DNA, 14 bp, Artificial sequence
  synthetic sequence
gcgggatgattctg

SEQ ID NO: 7607 - DNA, 14 bp, Artificial sequence
  synthetic sequence
cagtctcgtgctag

SEQ ID NO: 7608 - DNA, 14 bp, Artificial sequence
  synthetic sequence
acttgtctgaacaa

SEQ ID NO: 7609 - DNA, 14 bp, Artificial sequence
  synthetic sequence
gactctcgtatcga

SEQ ID NO: 7610 - DNA, 14 bp, Artificial sequence
  synthetic sequence
aagattgattacgc

SEQ ID NO: 7611 - DNA, 14 bp, Artificial sequence
  synthetic sequence
accttaattggcca

SEQ ID NO: 7612 - DNA, 14 bp, Artificial sequence
  synthetic sequence
tataacaagagttg

SEQ ID NO: 7613 - DNA, 14 bp, Artificial sequence
  synthetic sequence
ttaggtgacactcc

SEQ ID NO: 7614 - DNA, 14 bp, Artificial sequence
  synthetic sequence
tttcacgagcggtg

SEQ ID NO: 7615 - DNA, 14 bp, Artificial sequence
  synthetic sequence
ccacggaggttctt

SEQ ID NO: 7616 - DNA, 14 bp, Artificial sequence
  synthetic sequence
tatcccttgaaacc

SEQ ID NO: 7617 - DNA, 14 bp, Artificial sequence
  synthetic sequence
tggtcaagtggtcg

SEQ ID NO: 7618 - DNA, 14 bp, Artificial sequence
  synthetic sequence
ggggtttgtcgccg

SEQ ID NO: 7619 - DNA, 14 bp, Artificial sequence
  synthetic sequence
gatatcctaaggtg

SEQ ID NO: 7620 - DNA, 14 bp, Artificial sequence
  synthetic sequence
aatcgcgctaaatt

SEQ ID NO: 7621 - DNA, 14 bp, Artificial sequence
  synthetic sequence
atacgtgaatgcgt

SEQ ID NO: 7622 - DNA, 14 bp, Artificial sequence
  synthetic sequence
gataacctctaggt

SEQ ID NO: 7623 - DNA, 14 bp, Artificial sequence
  synthetic sequence
atcctcagttcggc

SEQ ID NO: 7624 - DNA, 14 bp, Artificial sequence
  synthetic sequence
gtatggagcgttac

SEQ ID NO: 7625 - DNA, 14 bp, Artificial sequence
  synthetic sequence
gactcttcgaggtc

SEQ ID NO: 7626 - DNA, 14 bp, Artificial sequence
  synthetic sequence
gatcatagaagttc

SEQ ID NO: 7627 - DNA, 14 bp, Artificial sequence
  synthetic sequence
atccacacttctaa

SEQ ID NO: 7628 - DNA, 14 bp, Artificial sequence
  synthetic sequence
gtttcgtgagaaaa

SEQ ID NO: 7629 - DNA, 14 bp, Artificial sequence
  synthetic sequence
tggggataattccc

SEQ ID NO: 7630 - DNA, 14 bp, Artificial sequence
  synthetic sequence
tacagttactagag

SEQ ID NO: 7631 - DNA, 14 bp, Artificial sequence
  synthetic sequence
gccgttagccatct

SEQ ID NO: 7632 - DNA, 14 bp, Artificial sequence
  synthetic sequence
cgagggtttatagg

SEQ ID NO: 7633 - DNA, 14 bp, Artificial sequence
  synthetic sequence
atcctgagtgctcg

SEQ ID NO: 7634 - DNA, 14 bp, Artificial sequence
  synthetic sequence
aacgttttcggaga

SEQ ID NO: 7635 - DNA, 14 bp, Artificial sequence
  synthetic sequence
ttacctcggggcgt

SEQ ID NO: 7636 - DNA, 14 bp, Artificial sequence
  synthetic sequence
ttgaggagaagtat

SEQ ID NO: 7637 - DNA, 14 bp, Artificial sequence
  synthetic sequence
actctataacctga

SEQ ID NO: 7638 - DNA, 14 bp, Artificial sequence
  synthetic sequence
ttatcgctacacaa

SEQ ID NO: 7639 - DNA, 14 bp, Artificial sequence
  synthetic sequence
aatcatcgggtcgt

SEQ ID NO: 7640 - DNA, 14 bp, Artificial sequence
  synthetic sequence
tggagcacgttgct

SEQ ID NO: 7641 - DNA, 14 bp, Artificial sequence
  synthetic sequence
tcattaggtaagag

SEQ ID NO: 7642 - DNA, 14 bp, Artificial sequence
  synthetic sequence
gcctgcattccctg

SEQ ID NO: 7643 - DNA, 14 bp, Artificial sequence
  synthetic sequence
ttttggagaagaca

SEQ ID NO: 7644 - DNA, 14 bp, Artificial sequence
  synthetic sequence
ctttcgagagacct

SEQ ID NO: 7645 - DNA, 14 bp, Artificial sequence
  synthetic sequence
tgctaggtatcccc

SEQ ID NO: 7646 - DNA, 14 bp, Artificial sequence
  synthetic sequence
atcgtccgttcccg

SEQ ID NO: 7647 - DNA, 14 bp, Artificial sequence
  synthetic sequence
atcgctcccgtact

SEQ ID NO: 7648 - DNA, 14 bp, Artificial sequence
  synthetic sequence
tgtataagaaacgt

SEQ ID NO: 7649 - DNA, 14 bp, Artificial sequence
  synthetic sequence
ggcacgcttgtact

SEQ ID NO: 7650 - DNA, 14 bp, Artificial sequence
  synthetic sequence
taatagttgcgaac

SEQ ID NO: 7651 - DNA, 14 bp, Artificial sequence
  synthetic sequence
tctatcattcgaac

SEQ ID NO: 7652 - DNA, 14 bp, Artificial sequence
  synthetic sequence
gactccgtgttact

SEQ ID NO: 7653 - DNA, 14 bp, Artificial sequence
  synthetic sequence
ctagtaatggtatc

SEQ ID NO: 7654 - DNA, 14 bp, Artificial sequence
  synthetic sequence
acggtctattcgtc

SEQ ID NO: 7655 - DNA, 14 bp, Artificial sequence
  synthetic sequence
cgagtgctctcctt

SEQ ID NO: 7656 - DNA, 14 bp, Artificial sequence
  synthetic sequence
gtggattcacatgt

SEQ ID NO: 7657 - DNA, 14 bp, Artificial sequence
  synthetic sequence
ttactgtggctaga

SEQ ID NO: 7658 - DNA, 14 bp, Artificial sequence
  synthetic sequence
atttaaagtcagtc

SEQ ID NO: 7659 - DNA, 14 bp, Artificial sequence
  synthetic sequence
catcatcttcatcg

SEQ ID NO: 7660 - DNA, 14 bp, Artificial sequence
  synthetic sequence
tatagaagtgcatt

SEQ ID NO: 7661 - DNA, 14 bp, Artificial sequence
  synthetic sequence
tctggagtctcgtc

SEQ ID NO: 7662 - DNA, 14 bp, Artificial sequence
  synthetic sequence
tatccacggtgtgt

SEQ ID NO: 7663 - DNA, 14 bp, Artificial sequence
  synthetic sequence
tatgtccggctcat

SEQ ID NO: 7664 - DNA, 14 bp, Artificial sequence
  synthetic sequence
agtttataaggact

SEQ ID NO: 7665 - DNA, 14 bp, Artificial sequence
  synthetic sequence
cgagtgtttcgata

SEQ ID NO: 7666 - DNA, 14 bp, Artificial sequence
  synthetic sequence
tgttactcaataac

SEQ ID NO: 7667 - DNA, 14 bp, Artificial sequence
  synthetic sequence
acagtttccatcta

SEQ ID NO: 7668 - DNA, 14 bp, Artificial sequence
  synthetic sequence
gtacaatgcccttt

SEQ ID NO: 7669 - DNA, 14 bp, Artificial sequence
  synthetic sequence
taagtagatctatg

SEQ ID NO: 7670 - DNA, 14 bp, Artificial sequence
  synthetic sequence
cctaattttggggc

SEQ ID NO: 7671 - DNA, 14 bp, Artificial sequence
  synthetic sequence
ctcatatgcgtagt

SEQ ID NO: 7672 - DNA, 14 bp, Artificial sequence
  synthetic sequence
gcttgcgtctgtgg

SEQ ID NO: 7673 - DNA, 14 bp, Artificial sequence
  synthetic sequence
aatgacattacttc

SEQ ID NO: 7674 - DNA, 14 bp, Artificial sequence
  synthetic sequence
cgtgaatatccgtt

SEQ ID NO: 7675 - DNA, 14 bp, Artificial sequence
  synthetic sequence
cgttagcgactttg

SEQ ID NO: 7676 - DNA, 14 bp, Artificial sequence
  synthetic sequence
tctattgtgcagca

SEQ ID NO: 7677 - DNA, 14 bp, Artificial sequence
  synthetic sequence
gataagaggttatt

SEQ ID NO: 7678 - DNA, 14 bp, Artificial sequence
  synthetic sequence
cgcttctacatagt

SEQ ID NO: 7679 - DNA, 14 bp, Artificial sequence
  synthetic sequence
agggtccttagtat

SEQ ID NO: 7680 - DNA, 14 bp, Artificial sequence
  synthetic sequence
tactgtaacgtagt

SEQ ID NO: 7681 - DNA, 14 bp, Artificial sequence
  synthetic sequence
catgttgagatggt

SEQ ID NO: 7682 - DNA, 14 bp, Artificial sequence
  synthetic sequence
acacatttattgcc

SEQ ID NO: 7683 - DNA, 14 bp, Artificial sequence
  synthetic sequence
tctgggccttgctc

SEQ ID NO: 7684 - DNA, 14 bp, Artificial sequence
  synthetic sequence
gcaatatttctagg

SEQ ID NO: 7685 - DNA, 14 bp, Artificial sequence
  synthetic sequence
actagtctgattcc

SEQ ID NO: 7686 - DNA, 14 bp, Artificial sequence
  synthetic sequence
ccaatgaagtattt

SEQ ID NO: 7687 - DNA, 14 bp, Artificial sequence
  synthetic sequence
gcgaaatatttcgt

SEQ ID NO: 7688 - DNA, 14 bp, Artificial sequence
  synthetic sequence
tattatccaactgc

SEQ ID NO: 7689 - DNA, 14 bp, Artificial sequence
  synthetic sequence
tcttttagcacccc

SEQ ID NO: 7690 - DNA, 14 bp, Artificial sequence
  synthetic sequence
ttttaaggataggc

SEQ ID NO: 7691 - DNA, 14 bp, Artificial sequence
  synthetic sequence
cgtaacgctgtgtt

SEQ ID NO: 7692 - DNA, 14 bp, Artificial sequence
  synthetic sequence
ctaaacatttcatc

SEQ ID NO: 7693 - DNA, 14 bp, Artificial sequence
  synthetic sequence
gaagttctactata

SEQ ID NO: 7694 - DNA, 14 bp, Artificial sequence
  synthetic sequence
gctggtatgttcgg

SEQ ID NO: 7695 - DNA, 14 bp, Artificial sequence
  synthetic sequence
tcggatacgatttg

SEQ ID NO: 7696 - DNA, 14 bp, Artificial sequence
  synthetic sequence
ctaaagttgtctac

SEQ ID NO: 7697 - DNA, 14 bp, Artificial sequence
  synthetic sequence
tcccattctgaaat

SEQ ID NO: 7698 - DNA, 14 bp, Artificial sequence
  synthetic sequence
atagcttgatggat

SEQ ID NO: 7699 - DNA, 14 bp, Artificial sequence
  synthetic sequence
gtatcaatggttgg

SEQ ID NO: 7700 - DNA, 14 bp, Artificial sequence
  synthetic sequence
caagtctcttggta

SEQ ID NO: 7701 - DNA, 14 bp, Artificial sequence
  synthetic sequence
gttgatagttaaga

SEQ ID NO: 7702 - DNA, 14 bp, Artificial sequence
  synthetic sequence
gtttaacatccctg

SEQ ID NO: 7703 - DNA, 14 bp, Artificial sequence
  synthetic sequence
ggtcgagactgttt

SEQ ID NO: 7704 - DNA, 14 bp, Artificial sequence
  synthetic sequence
ttgcgcgtatggtg

SEQ ID NO: 7705 - DNA, 14 bp, Artificial sequence
  synthetic sequence
ttgctgatcgaata

SEQ ID NO: 7706 - DNA, 14 bp, Artificial sequence
  synthetic sequence
gggtctttgagaat

SEQ ID NO: 7707 - DNA, 14 bp, Artificial sequence
  synthetic sequence
atggaggtatatta

SEQ ID NO: 7708 - DNA, 14 bp, Artificial sequence
  synthetic sequence
aattgccttataaa

SEQ ID NO: 7709 - DNA, 14 bp, Artificial sequence
  synthetic sequence
tcatgagactctgt

SEQ ID NO: 7710 - DNA, 14 bp, Artificial sequence
  synthetic sequence
ttaatgactgggct

SEQ ID NO: 7711 - DNA, 14 bp, Artificial sequence
  synthetic sequence
attatggcctgcct

SEQ ID NO: 7712 - DNA, 14 bp, Artificial sequence
  synthetic sequence
ctaacttccatatg

SEQ ID NO: 7713 - DNA, 14 bp, Artificial sequence
  synthetic sequence
ctgctgtatgaact

SEQ ID NO: 7714 - DNA, 14 bp, Artificial sequence
  synthetic sequence
tacgtctgcgctgt

SEQ ID NO: 7715 - DNA, 14 bp, Artificial sequence
  synthetic sequence
cttgagcgtttggc

SEQ ID NO: 7716 - DNA, 14 bp, Artificial sequence
  synthetic sequence
tagattagtcgtaa

SEQ ID NO: 7717 - DNA, 14 bp, Artificial sequence
  synthetic sequence
gtcgaatggatctt

SEQ ID NO: 7718 - DNA, 14 bp, Artificial sequence
  synthetic sequence
gtggcagatttgct

SEQ ID NO: 7719 - DNA, 14 bp, Artificial sequence
  synthetic sequence
cctcttagaatcat

SEQ ID NO: 7720 - DNA, 14 bp, Artificial sequence
  synthetic sequence
ttctgtaccgagtc

SEQ ID NO: 7721 - DNA, 14 bp, Artificial sequence
  synthetic sequence
gtgggtttgaaggt

SEQ ID NO: 7722 - DNA, 14 bp, Artificial sequence
  synthetic sequence
tcgttacagtctgg

SEQ ID NO: 7723 - DNA, 14 bp, Artificial sequence
  synthetic sequence
gactgagtgctgtt

SEQ ID NO: 7724 - DNA, 14 bp, Artificial sequence
  synthetic sequence
tcaatacctatact

SEQ ID NO: 7725 - DNA, 14 bp, Artificial sequence
  synthetic sequence
tgtttggggaggtc

SEQ ID NO: 7726 - DNA, 14 bp, Artificial sequence
  synthetic sequence
cactaacgttggtt

SEQ ID NO: 7727 - DNA, 14 bp, Artificial sequence
  synthetic sequence
tcctacctcatatc

SEQ ID NO: 7728 - DNA, 14 bp, Artificial sequence
  synthetic sequence
ttggtcggtgcact

SEQ ID NO: 7729 - DNA, 14 bp, Artificial sequence
  synthetic sequence
tttaggtctggaag

SEQ ID NO: 7730 - DNA, 14 bp, Artificial sequence
  synthetic sequence
actgtcagttgaat

SEQ ID NO: 7731 - DNA, 14 bp, Artificial sequence
  synthetic sequence
ggctatcctctaat

SEQ ID NO: 7732 - DNA, 14 bp, Artificial sequence
  synthetic sequence
caacgttctctgtg

SEQ ID NO: 7733 - DNA, 14 bp, Artificial sequence
  synthetic sequence
gctggtaacaattt

SEQ ID NO: 7734 - DNA, 14 bp, Artificial sequence
  synthetic sequence
ttacatatcagcat

SEQ ID NO: 7735 - DNA, 14 bp, Artificial sequence
  synthetic sequence
caaatttcctatgc

SEQ ID NO: 7736 - DNA, 14 bp, Artificial sequence
  synthetic sequence
gtatagtttaaccc

SEQ ID NO: 7737 - DNA, 14 bp, Artificial sequence
  synthetic sequence
aattcccgtgattc

SEQ ID NO: 7738 - DNA, 14 bp, Artificial sequence
  synthetic sequence
ttgacttagatagc

SEQ ID NO: 7739 - DNA, 14 bp, Artificial sequence
  synthetic sequence
gactcactttcgtg

SEQ ID NO: 7740 - DNA, 14 bp, Artificial sequence
  synthetic sequence
ctatgcgactttag

SEQ ID NO: 7741 - DNA, 14 bp, Artificial sequence
  synthetic sequence
agtagtcgctgtgt

SEQ ID NO: 7742 - DNA, 14 bp, Artificial sequence
  synthetic sequence
tagtaatgactgtg

SEQ ID NO: 7743 - DNA, 14 bp, Artificial sequence
  synthetic sequence
acgctctttctcgg

SEQ ID NO: 7744 - DNA, 14 bp, Artificial sequence
  synthetic sequence
tcggcgtcttggta

SEQ ID NO: 7745 - DNA, 14 bp, Artificial sequence
  synthetic sequence
tttaggaatcgatc

SEQ ID NO: 7746 - DNA, 14 bp, Artificial sequence
  synthetic sequence
acgctcattcgttc

SEQ ID NO: 7747 - DNA, 14 bp, Artificial sequence
  synthetic sequence
ttagttcgataccc

SEQ ID NO: 7748 - DNA, 14 bp, Artificial sequence
  synthetic sequence
aatcgatgtattac

SEQ ID NO: 7749 - DNA, 14 bp, Artificial sequence
  synthetic sequence
ttagatacactagt

SEQ ID NO: 7750 - DNA, 14 bp, Artificial sequence
  synthetic sequence
tactcgggattcta

SEQ ID NO: 7751 - DNA, 14 bp, Artificial sequence
  synthetic sequence
tcatctgcgtgcat

SEQ ID NO: 7752 - DNA, 14 bp, Artificial sequence
  synthetic sequence
ctgttagccgttcg

SEQ ID NO: 7753 - DNA, 14 bp, Artificial sequence
  synthetic sequence
gtatctgttaagac

SEQ ID NO: 7754 - DNA, 14 bp, Artificial sequence
  synthetic sequence
tactgaaattggct

SEQ ID NO: 7755 - DNA, 14 bp, Artificial sequence
  synthetic sequence
tttcaccaccatct

SEQ ID NO: 7756 - DNA, 14 bp, Artificial sequence
  synthetic sequence
acctcggttgcgtt

SEQ ID NO: 7757 - DNA, 14 bp, Artificial sequence
  synthetic sequence
tccgaagttggtat

SEQ ID NO: 7758 - DNA, 14 bp, Artificial sequence
  synthetic sequence
taatgccgtgcttg

SEQ ID NO: 7759 - DNA, 14 bp, Artificial sequence
  synthetic sequence
tcccaccatggttt

SEQ ID NO: 7760 - DNA, 14 bp, Artificial sequence
  synthetic sequence
atctgcttcacagt

SEQ ID NO: 7761 - DNA, 14 bp, Artificial sequence
  synthetic sequence
gcttaatgaaattc

SEQ ID NO: 7762 - DNA, 14 bp, Artificial sequence
  synthetic sequence
ggctatatgttcag

SEQ ID NO: 7763 - DNA, 14 bp, Artificial sequence
  synthetic sequence
attgtaattgagcc

SEQ ID NO: 7764 - DNA, 14 bp, Artificial sequence
  synthetic sequence
ttctccgttgccgc

SEQ ID NO: 7765 - DNA, 14 bp, Artificial sequence
  synthetic sequence
attgtcccgtaggt

SEQ ID NO: 7766 - DNA, 14 bp, Artificial sequence
  synthetic sequence
atggtacgtttcga

SEQ ID NO: 7767 - DNA, 14 bp, Artificial sequence
  synthetic sequence
cttggttggctccg

SEQ ID NO: 7768 - DNA, 14 bp, Artificial sequence
  synthetic sequence
ccgaggtgtgcttt

SEQ ID NO: 7769 - DNA, 14 bp, Artificial sequence
  synthetic sequence
tactaatccggttc

SEQ ID NO: 7770 - DNA, 14 bp, Artificial sequence
  synthetic sequence
tgacgtactggtct

SEQ ID NO: 7771 - DNA, 14 bp, Artificial sequence
  synthetic sequence
tttcgaaccctgat

SEQ ID NO: 7772 - DNA, 14 bp, Artificial sequence
  synthetic sequence
cttctgcatcatca

SEQ ID NO: 7773 - DNA, 14 bp, Artificial sequence
  synthetic sequence
gtttttgccagccc

SEQ ID NO: 7774 - DNA, 14 bp, Artificial sequence
  synthetic sequence
cgagttccttatca

SEQ ID NO: 7775 - DNA, 14 bp, Artificial sequence
  synthetic sequence
taagaattttgcga

SEQ ID NO: 7776 - DNA, 14 bp, Artificial sequence
  synthetic sequence
caatatattgagtg

SEQ ID NO: 7777 - DNA, 14 bp, Artificial sequence
  synthetic sequence
attgattcggactg

SEQ ID NO: 7778 - DNA, 14 bp, Artificial sequence
  synthetic sequence
accactagatttct

SEQ ID NO: 7779 - DNA, 14 bp, Artificial sequence
  synthetic sequence
actttacaaactct

SEQ ID NO: 7780 - DNA, 14 bp, Artificial sequence
  synthetic sequence
acttgacatgatgt

SEQ ID NO: 7781 - DNA, 14 bp, Artificial sequence
  synthetic sequence
gtgatctttgccgg

SEQ ID NO: 7782 - DNA, 14 bp, Artificial sequence
  synthetic sequence
tgcgcgtttggaat

SEQ ID NO: 7783 - DNA, 14 bp, Artificial sequence
  synthetic sequence
agtgcctagtgtat

SEQ ID NO: 7784 - DNA, 14 bp, Artificial sequence
  synthetic sequence
tccttctcatgacg

SEQ ID NO: 7785 - DNA, 14 bp, Artificial sequence
  synthetic sequence
ccttacctcttccg

SEQ ID NO: 7786 - DNA, 14 bp, Artificial sequence
  synthetic sequence
gctgtcctgtgtaa

SEQ ID NO: 7787 - DNA, 14 bp, Artificial sequence
  synthetic sequence
gatctcgtatggat

SEQ ID NO: 7788 - DNA, 14 bp, Artificial sequence
  synthetic sequence
tggtttgtacgcag

SEQ ID NO: 7789 - DNA, 14 bp, Artificial sequence
  synthetic sequence
attggtcgtccatg

SEQ ID NO: 7790 - DNA, 14 bp, Artificial sequence
  synthetic sequence
tatacattcctacc

SEQ ID NO: 7791 - DNA, 14 bp, Artificial sequence
  synthetic sequence
attcggttcgtgca

SEQ ID NO: 7792 - DNA, 14 bp, Artificial sequence
  synthetic sequence
tgagctgtggtatc

SEQ ID NO: 7793 - DNA, 14 bp, Artificial sequence
  synthetic sequence
acagtttagccctt

SEQ ID NO: 7794 - DNA, 14 bp, Artificial sequence
  synthetic sequence
caattgtacatcct

SEQ ID NO: 7795 - DNA, 14 bp, Artificial sequence
  synthetic sequence
ataacggctctgtt

SEQ ID NO: 7796 - DNA, 14 bp, Artificial sequence
  synthetic sequence
ctttcctacgtcag

SEQ ID NO: 7797 - DNA, 14 bp, Artificial sequence
  synthetic sequence
tctagtcctgtaca

SEQ ID NO: 7798 - DNA, 14 bp, Artificial sequence
  synthetic sequence
ttgcgggtgcgtta

SEQ ID NO: 7799 - DNA, 14 bp, Artificial sequence
  synthetic sequence
agtttgactctagc

SEQ ID NO: 7800 - DNA, 14 bp, Artificial sequence
  synthetic sequence
ttacatcaatccct

SEQ ID NO: 7801 - DNA, 14 bp, Artificial sequence
  synthetic sequence
cggttagattgtag

SEQ ID NO: 7802 - DNA, 14 bp, Artificial sequence
  synthetic sequence
gggtagcttcatta

SEQ ID NO: 7803 - DNA, 14 bp, Artificial sequence
  synthetic sequence
ggatacgtatttgc

SEQ ID NO: 7804 - DNA, 14 bp, Artificial sequence
  synthetic sequence
ccattggcgtctat

SEQ ID NO: 7805 - DNA, 14 bp, Artificial sequence
  synthetic sequence
ccgattgagtcttg

SEQ ID NO: 7806 - DNA, 14 bp, Artificial sequence
  synthetic sequence
ttggagtagatcta

SEQ ID NO: 7807 - DNA, 14 bp, Artificial sequence
  synthetic sequence
atttggacttacgc

SEQ ID NO: 7808 - DNA, 14 bp, Artificial sequence
  synthetic sequence
tgtcttagatagcc

SEQ ID NO: 7809 - DNA, 14 bp, Artificial sequence
  synthetic sequence
ttctgactacaggt

SEQ ID NO: 7810 - DNA, 14 bp, Artificial sequence
  synthetic sequence
caattcatgacttc

SEQ ID NO: 7811 - DNA, 14 bp, Artificial sequence
  synthetic sequence
cactttggtaactg

SEQ ID NO: 7812 - DNA, 14 bp, Artificial sequence
  synthetic sequence
ttatagctgagact

SEQ ID NO: 7813 - DNA, 14 bp, Artificial sequence
  synthetic sequence
aaggatctttgctg

SEQ ID NO: 7814 - DNA, 14 bp, Artificial sequence
  synthetic sequence
gttttgacatacag

SEQ ID NO: 7815 - DNA, 14 bp, Artificial sequence
  synthetic sequence
tactgttgtgagcg

SEQ ID NO: 7816 - DNA, 14 bp, Artificial sequence
  synthetic sequence
tcaggttctactgg

SEQ ID NO: 7817 - DNA, 14 bp, Artificial sequence
  synthetic sequence
tactgtgcgggttg

SEQ ID NO: 7818 - DNA, 14 bp, Artificial sequence
  synthetic sequence
cagcgtttttgccc

SEQ ID NO: 7819 - DNA, 14 bp, Artificial sequence
  synthetic sequence
ctcttctcaaataa

SEQ ID NO: 7820 - DNA, 14 bp, Artificial sequence
  synthetic sequence
cgtgctgagtttca

SEQ ID NO: 7821 - DNA, 14 bp, Artificial sequence
  synthetic sequence
tcctttcccgtaag

SEQ ID NO: 7822 - DNA, 14 bp, Artificial sequence
  synthetic sequence
gtatggtgattcgg

SEQ ID NO: 7823 - DNA, 14 bp, Artificial sequence
  synthetic sequence
gtaacgttttaagc

SEQ ID NO: 7824 - DNA, 14 bp, Artificial sequence
  synthetic sequence
gagtttagatatca

SEQ ID NO: 7825 - DNA, 14 bp, Artificial sequence
  synthetic sequence
gaatttttggcaag

SEQ ID NO: 7826 - DNA, 14 bp, Artificial sequence
  synthetic sequence
ttggaagttcgtgg

SEQ ID NO: 7827 - DNA, 14 bp, Artificial sequence
  synthetic sequence
tgagtcacttaaat

SEQ ID NO: 7828 - DNA, 14 bp, Artificial sequence
  synthetic sequence
tcagccgttcctgt

SEQ ID NO: 7829 - DNA, 14 bp, Artificial sequence
  synthetic sequence
ctcgagtacttggt

SEQ ID NO: 7830 - DNA, 14 bp, Artificial sequence
  synthetic sequence
tcatgtagtcagtc

SEQ ID NO: 7831 - DNA, 14 bp, Artificial sequence
  synthetic sequence
cttacggttaatgg

SEQ ID NO: 7832 - DNA, 14 bp, Artificial sequence
  synthetic sequence
cgttgattacgtac

SEQ ID NO: 7833 - DNA, 14 bp, Artificial sequence
  synthetic sequence
gtcaggcctagttt

SEQ ID NO: 7834 - DNA, 14 bp, Artificial sequence
  synthetic sequence
aagcgcttaggttt

SEQ ID NO: 7835 - DNA, 14 bp, Artificial sequence
  synthetic sequence
tggctgaatgttgg

SEQ ID NO: 7836 - DNA, 14 bp, Artificial sequence
  synthetic sequence
cggtaattggattc

SEQ ID NO: 7837 - DNA, 14 bp, Artificial sequence
  synthetic sequence
gtaccaattttacc

SEQ ID NO: 7838 - DNA, 14 bp, Artificial sequence
  synthetic sequence
ctgtggatctcaat

SEQ ID NO: 7839 - DNA, 14 bp, Artificial sequence
  synthetic sequence
acatttgcctcgtg

SEQ ID NO: 7840 - DNA, 14 bp, Artificial sequence
  synthetic sequence
agactctgttgcta

SEQ ID NO: 7841 - DNA, 14 bp, Artificial sequence
  synthetic sequence
gtgttagcttacca

SEQ ID NO: 7842 - DNA, 14 bp, Artificial sequence
  synthetic sequence
tatttgccatgcga

SEQ ID NO: 7843 - DNA, 14 bp, Artificial sequence
  synthetic sequence
gcttcattaggtgc

SEQ ID NO: 7844 - DNA, 14 bp, Artificial sequence
  synthetic sequence
tagatcagggttta

SEQ ID NO: 7845 - DNA, 14 bp, Artificial sequence
  synthetic sequence
agatttaactgtcc

SEQ ID NO: 7846 - DNA, 14 bp, Artificial sequence
  synthetic sequence
cgatctgttggatg

SEQ ID NO: 7847 - DNA, 14 bp, Artificial sequence
  synthetic sequence
taaatggccctatt

SEQ ID NO: 7848 - DNA, 14 bp, Artificial sequence
  synthetic sequence
ttatctcggcactg

SEQ ID NO: 7849 - DNA, 14 bp, Artificial sequence
  synthetic sequence
caatcctatgattg

SEQ ID NO: 7850 - DNA, 14 bp, Artificial sequence
  synthetic sequence
atcaagatagtttg

SEQ ID NO: 7851 - DNA, 14 bp, Artificial sequence
  synthetic sequence
atttgattcgaaaa

SEQ ID NO: 7852 - DNA, 14 bp, Artificial sequence
  synthetic sequence
cgaggttgtcttca

SEQ ID NO: 7853 - DNA, 14 bp, Artificial sequence
  synthetic sequence
tatcaggatcgatt

SEQ ID NO: 7854 - DNA, 14 bp, Artificial sequence
  synthetic sequence
tctagatggcatgt

SEQ ID NO: 7855 - DNA, 14 bp, Artificial sequence
  synthetic sequence
taaaatgggttctg

SEQ ID NO: 7856 - DNA, 14 bp, Artificial sequence
  synthetic sequence
gagattgaatgtct

SEQ ID NO: 7857 - DNA, 14 bp, Artificial sequence
  synthetic sequence
tgctgattctcacg

SEQ ID NO: 7858 - DNA, 14 bp, Artificial sequence
  synthetic sequence
ggatccatattgat

SEQ ID NO: 7859 - DNA, 14 bp, Artificial sequence
  synthetic sequence
ttgtactcgctagc

SEQ ID NO: 7860 - DNA, 14 bp, Artificial sequence
  synthetic sequence
tcattccctgtccg

SEQ ID NO: 7861 - DNA, 14 bp, Artificial sequence
  synthetic sequence
ttcagggcttggtg

SEQ ID NO: 7862 - DNA, 14 bp, Artificial sequence
  synthetic sequence
ctgattcatgcgct

SEQ ID NO: 7863 - DNA, 14 bp, Artificial sequence
  synthetic sequence
gacgctattggctt

SEQ ID NO: 7864 - DNA, 14 bp, Artificial sequence
  synthetic sequence
gtgcttatcgtacc

SEQ ID NO: 7865 - DNA, 14 bp, Artificial sequence
  synthetic sequence
ataatgtatggatg

SEQ ID NO: 7866 - DNA, 14 bp, Artificial sequence
  synthetic sequence
cactctaagtttaa

SEQ ID NO: 7867 - DNA, 14 bp, Artificial sequence
  synthetic sequence
caatttagtatcac

SEQ ID NO: 7868 - DNA, 14 bp, Artificial sequence
  synthetic sequence
gtcttcgtagccta

SEQ ID NO: 7869 - DNA, 14 bp, Artificial sequence
  synthetic sequence
cacattgtcttaag

SEQ ID NO: 7870 - DNA, 14 bp, Artificial sequence
  synthetic sequence
caattatcgtctta

SEQ ID NO: 7871 - DNA, 14 bp, Artificial sequence
  synthetic sequence
cttaagtctcttcc

SEQ ID NO: 7872 - DNA, 14 bp, Artificial sequence
  synthetic sequence
attctaccgattgt

SEQ ID NO: 7873 - DNA, 14 bp, Artificial sequence
  synthetic sequence
tagttgcttctcag

SEQ ID NO: 7874 - DNA, 14 bp, Artificial sequence
  synthetic sequence
tatctccctcttca

SEQ ID NO: 7875 - DNA, 14 bp, Artificial sequence
  synthetic sequence
tttcctctagacat

SEQ ID NO: 7876 - DNA, 14 bp, Artificial sequence
  synthetic sequence
ttatgctatcgtcg

SEQ ID NO: 7877 - DNA, 14 bp, Artificial sequence
  synthetic sequence
ccgtatttccgtat

SEQ ID NO: 7878 - DNA, 14 bp, Artificial sequence
  synthetic sequence
ggatttttcctcag

SEQ ID NO: 7879 - DNA, 14 bp, Artificial sequence
  synthetic sequence
gttggtcgatctct

SEQ ID NO: 7880 - DNA, 14 bp, Artificial sequence
  synthetic sequence
tctctccgtcctgt

SEQ ID NO: 7881 - DNA, 14 bp, Artificial sequence
  synthetic sequence
attcagcctttaat

SEQ ID NO: 7882 - DNA, 14 bp, Artificial sequence
  synthetic sequence
ctcattattctggc

SEQ ID NO: 7883 - DNA, 14 bp, Artificial sequence
  synthetic sequence
atacttctcacgtt

SEQ ID NO: 7884 - DNA, 14 bp, Artificial sequence
  synthetic sequence
tttgctacgtcact

SEQ ID NO: 7885 - DNA, 14 bp, Artificial sequence
  synthetic sequence
ctttctctgactcg

SEQ ID NO: 7886 - DNA, 14 bp, Artificial sequence
  synthetic sequence
gttttatacggtaa

SEQ ID NO: 7887 - DNA, 14 bp, Artificial sequence
  synthetic sequence
gttagatgtgttga

SEQ ID NO: 7888 - DNA, 14 bp, Artificial sequence
  synthetic sequence
tgagtgatttagtg

SEQ ID NO: 7889 - DNA, 14 bp, Artificial sequence
  synthetic sequence
tttactgaacttgc

SEQ ID NO: 7890 - DNA, 14 bp, Artificial sequence
  synthetic sequence
taatggttgcttga

SEQ ID NO: 7891 - DNA, 14 bp, Artificial sequence
  synthetic sequence
tcggtattggcttc

SEQ ID NO: 7892 - DNA, 14 bp, Artificial sequence
  synthetic sequence
tgcattaatactct

SEQ ID NO: 7893 - DNA, 14 bp, Artificial sequence
  synthetic sequence
ttctatctgtcgga

SEQ ID NO: 7894 - DNA, 14 bp, Artificial sequence
  synthetic sequence
ggtattatgggtct

SEQ ID NO: 7895 - DNA, 14 bp, Artificial sequence
  synthetic sequence
ctttcgtgtctcaa

SEQ ID NO: 7896 - DNA, 14 bp, Artificial sequence
  synthetic sequence
ttgctccgttggta

SEQ ID NO: 7897 - DNA, 14 bp, Artificial sequence
  synthetic sequence
gatgatgttaggtt

SEQ ID NO: 7898 - DNA, 14 bp, Artificial sequence
  synthetic sequence
cttcatgcgccttt

SEQ ID NO: 7899 - DNA, 14 bp, Artificial sequence
  synthetic sequence
ctgtattccttgcc

SEQ ID NO: 7900 - DNA, 14 bp, Artificial sequence
  synthetic sequence
tgtagtaaatcatt

SEQ ID NO: 7901 - DNA, 14 bp, Artificial sequence
  synthetic sequence
actgggttatctct

SEQ ID NO: 7902 - DNA, 14 bp, Artificial sequence
  synthetic sequence
gtccgctggtttta

SEQ ID NO: 7903 - DNA, 14 bp, Artificial sequence
  synthetic sequence
atgatttgctacat

SEQ ID NO: 7904 - DNA, 14 bp, Artificial sequence
  synthetic sequence
tcttccccttagat

SEQ ID NO: 7905 - DNA, 14 bp, Artificial sequence
  synthetic sequence
tattcgtctgcgat

SEQ ID NO: 7906 - DNA, 14 bp, Artificial sequence
  synthetic sequence
ttcggtattccact

SEQ ID NO: 7907 - DNA, 14 bp, Artificial sequence
  synthetic sequence
ctaggttttacaat

SEQ ID NO: 7908 - DNA, 14 bp, Artificial sequence
  synthetic sequence
agatttcgttcatc

SEQ ID NO: 7909 - DNA, 14 bp, Artificial sequence
  synthetic sequence
cctcatgtttgatg

SEQ ID NO: 7910 - DNA, 14 bp, Artificial sequence
  synthetic sequence
catggtttgtaact

SEQ ID NO: 7911 - DNA, 14 bp, Artificial sequence
  synthetic sequence
gctactttactctg

SEQ ID NO: 7912 - DNA, 14 bp, Artificial sequence
  synthetic sequence
tgcacttccctatt

SEQ ID NO: 7913 - DNA, 14 bp, Artificial sequence
  synthetic sequence
accttatcatgctt

SEQ ID NO: 7914 - DNA, 14 bp, Artificial sequence
  synthetic sequence
tgttctattgggca

SEQ ID NO: 7915 - DNA, 14 bp, Artificial sequence
  synthetic sequence
acgcttactttgtg

SEQ ID NO: 7916 - DNA, 14 bp, Artificial sequence
  synthetic sequence
ggtgctgtcgttta

SEQ ID NO: 7917 - DNA, 14 bp, Artificial sequence
  synthetic sequence
cactttatagttca

SEQ ID NO: 7918 - DNA, 14 bp, Artificial sequence
  synthetic sequence
tgctttttggaaga

SEQ ID NO: 7919 - DNA, 14 bp, Artificial sequence
  synthetic sequence
attgcctgcttctg

SEQ ID NO: 7920 - DNA, 14 bp, Artificial sequence
  synthetic sequence
aggagttcgttatt

SEQ ID NO: 7921 - DNA, 14 bp, Artificial sequence
  synthetic sequence
atactttttccaag

SEQ ID NO: 7922 - DNA, 14 bp, Artificial sequence
  synthetic sequence
tcgattgtgttagc

SEQ ID NO: 7923 - DNA, 14 bp, Artificial sequence
  synthetic sequence
tctctggcggtttg

SEQ ID NO: 7924 - DNA, 14 bp, Artificial sequence
  synthetic sequence
cttcgcattcttga

SEQ ID NO: 7925 - DNA, 14 bp, Artificial sequence
  synthetic sequence
gtcgtttcttcaac

SEQ ID NO: 7926 - DNA, 14 bp, Artificial sequence
  synthetic sequence
ttccattattcacg

SEQ ID NO: 7927 - DNA, 14 bp, Artificial sequence
  synthetic sequence
aatgtcgtctatat

SEQ ID NO: 7928 - DNA, 14 bp, Artificial sequence
  synthetic sequence
atttggtatggggt

SEQ ID NO: 7929 - DNA, 14 bp, Artificial sequence
  synthetic sequence
gtcaagttgttcgt

SEQ ID NO: 7930 - DNA, 14 bp, Artificial sequence
  synthetic sequence
tcgactttatacat

SEQ ID NO: 7931 - DNA, 14 bp, Artificial sequence
  synthetic sequence
tgtctgttccgatc

SEQ ID NO: 7932 - DNA, 14 bp, Artificial sequence
  synthetic sequence
tatacatgtgtctg

SEQ ID NO: 7933 - DNA, 14 bp, Artificial sequence
  synthetic sequence
gtgtgctaacttct

SEQ ID NO: 7934 - DNA, 14 bp, Artificial sequence
  synthetic sequence
gtccatatgctttg

SEQ ID NO: 7935 - DNA, 14 bp, Artificial sequence
  synthetic sequence
tacattgcttgtag

SEQ ID NO: 7936 - DNA, 14 bp, Artificial sequence
  synthetic sequence
cccttcctttcatg

SEQ ID NO: 7937 - DNA, 14 bp, Artificial sequence
  synthetic sequence
acatttgtacagtt

SEQ ID NO: 7938 - DNA, 14 bp, Artificial sequence
  synthetic sequence
gcttgttataacct

SEQ ID NO: 7939 - DNA, 14 bp, Artificial sequence
  synthetic sequence
ttggtatggatgtg

SEQ ID NO: 7940 - DNA, 14 bp, Artificial sequence
  synthetic sequence
aatgatttagtgta

SEQ ID NO: 7941 - DNA, 14 bp, Artificial sequence
  synthetic sequence
ttttcgtaaacatg

SEQ ID NO: 7942 - DNA, 14 bp, Artificial sequence
  synthetic sequence
atgaattagcttct

SEQ ID NO: 7943 - DNA, 14 bp, Artificial sequence
  synthetic sequence
ctacatttggtgct

SEQ ID NO: 7944 - DNA, 14 bp, Artificial sequence
  synthetic sequence
attgtggtgaattc

SEQ ID NO: 7945 - DNA, 14 bp, Artificial sequence
  synthetic sequence
tctatgaattagct

SEQ ID NO: 7946 - DNA, 14 bp, Artificial sequence
  synthetic sequence
ttactttccatcgc

SEQ ID NO: 7947 - DNA, 14 bp, Artificial sequence
  synthetic sequence
atctgttgcgtctc

SEQ ID NO: 7948 - DNA, 14 bp, Artificial sequence
  synthetic sequence
agctcgtgtgttat

SEQ ID NO: 7949 - DNA, 14 bp, Artificial sequence
  synthetic sequence
tttcgacgattatg

SEQ ID NO: 7950 - DNA, 14 bp, Artificial sequence
  synthetic sequence
taaggttgctttgg

SEQ ID NO: 7951 - DNA, 14 bp, Artificial sequence
  synthetic sequence
cgcgtgttgcttgt

SEQ ID NO: 7952 - DNA, 14 bp, Artificial sequence
  synthetic sequence
catatagttggtat

SEQ ID NO: 7953 - DNA, 14 bp, Artificial sequence
  synthetic sequence
tttctcacctataa

SEQ ID NO: 7954 - DNA, 14 bp, Artificial sequence
  synthetic sequence
tgtacttttaacgc

SEQ ID NO: 7955 - DNA, 14 bp, Artificial sequence
  synthetic sequence
ttggtcactttccg

SEQ ID NO: 7956 - DNA, 14 bp, Artificial sequence
  synthetic sequence
ttatggctcttccg

SEQ ID NO: 7957 - DNA, 14 bp, Artificial sequence
  synthetic sequence
tgctgatttatagc

SEQ ID NO: 7958 - DNA, 14 bp, Artificial sequence
  synthetic sequence
tggattttacagtc

SEQ ID NO: 7959 - DNA, 14 bp, Artificial sequence
  synthetic sequence
ttctcgtcagttgg

SEQ ID NO: 7960 - DNA, 14 bp, Artificial sequence
  synthetic sequence
tagatcgtttgtgc

SEQ ID NO: 7961 - DNA, 14 bp, Artificial sequence
  synthetic sequence
ttgcactttaaatc

SEQ ID NO: 7962 - DNA, 14 bp, Artificial sequence
  synthetic sequence
ctttacctgtataa

SEQ ID NO: 7963 - DNA, 14 bp, Artificial sequence
  synthetic sequence
tacaacgttcgttt

SEQ ID NO: 7964 - DNA, 14 bp, Artificial sequence
  synthetic sequence
cgttatatactcat

SEQ ID NO: 7965 - DNA, 14 bp, Artificial sequence
  synthetic sequence
tcctttattgacgg

SEQ ID NO: 7966 - DNA, 14 bp, Artificial sequence
  synthetic sequence
tgtgggttcttcaa

SEQ ID NO: 7967 - DNA, 14 bp, Artificial sequence
  synthetic sequence
tgcctcgtcattct

SEQ ID NO: 7968 - DNA, 14 bp, Artificial sequence
  synthetic sequence
tgttacgtttcaga

SEQ ID NO: 7969 - DNA, 14 bp, Artificial sequence
  synthetic sequence
atctcatacttgtc

SEQ ID NO: 7970 - DNA, 14 bp, Artificial sequence
  synthetic sequence
tgttagttcgtccg

SEQ ID NO: 7971 - DNA, 14 bp, Artificial sequence
  synthetic sequence
tacctttatagtcg

SEQ ID NO: 7972 - DNA, 14 bp, Artificial sequence
  synthetic sequence
atctggataattct

SEQ ID NO: 7973 - DNA, 14 bp, Artificial sequence
  synthetic sequence
ctatcgttttgcca

SEQ ID NO: 7974 - DNA, 14 bp, Artificial sequence
  synthetic sequence
aacctttttggctg

SEQ ID NO: 7975 - DNA, 14 bp, Artificial sequence
  synthetic sequence
atctacatgtctct

SEQ ID NO: 7976 - DNA, 14 bp, Artificial sequence
  synthetic sequence
catctttgacatct

SEQ ID NO: 7977 - DNA, 14 bp, Artificial sequence
  synthetic sequence
gtacttcctaactt

SEQ ID NO: 7978 - DNA, 14 bp, Artificial sequence
  synthetic sequence
ctatatcaattcta

SEQ ID NO: 7979 - DNA, 14 bp, Artificial sequence
  synthetic sequence
ttagatgtttcaca

SEQ ID NO: 7980 - DNA, 14 bp, Artificial sequence
  synthetic sequence
tagcattgtcgttc

SEQ ID NO: 7981 - DNA, 14 bp, Artificial sequence
  synthetic sequence
ccttgtctgctcgt

SEQ ID NO: 7982 - DNA, 14 bp, Artificial sequence
  synthetic sequence
ttagccgttgattc

SEQ ID NO: 7983 - DNA, 14 bp, Artificial sequence
  synthetic sequence
aacttactaatgtt

SEQ ID NO: 7984 - DNA, 14 bp, Artificial sequence
  synthetic sequence
agactttctttaca

SEQ ID NO: 7985 - DNA, 14 bp, Artificial sequence
  synthetic sequence
agttctaagtctct

SEQ ID NO: 7986 - DNA, 14 bp, Artificial sequence
  synthetic sequence
tggttttatagcga

SEQ ID NO: 7987 - DNA, 14 bp, Artificial sequence
  synthetic sequence
cacttcgttcctta

SEQ ID NO: 7988 - DNA, 14 bp, Artificial sequence
  synthetic sequence
tcatcagttacatt

SEQ ID NO: 7989 - DNA, 14 bp, Artificial sequence
  synthetic sequence
tgcgtttgtaatag

SEQ ID NO: 7990 - DNA, 14 bp, Artificial sequence
  synthetic sequence
ggatattaattcat

SEQ ID NO: 7991 - DNA, 14 bp, Artificial sequence
  synthetic sequence
gagtctcctgtgtt

SEQ ID NO: 7992 - DNA, 14 bp, Artificial sequence
  synthetic sequence
aatgtatggccttt

SEQ ID NO: 7993 - DNA, 14 bp, Artificial sequence
  synthetic sequence
tgccaagtgctttt

SEQ ID NO: 7994 - DNA, 14 bp, Artificial sequence
  synthetic sequence
actcctttgttccg

SEQ ID NO: 7995 - DNA, 14 bp, Artificial sequence
  synthetic sequence
gagtactttgatat

SEQ ID NO: 7996 - DNA, 14 bp, Artificial sequence
  synthetic sequence
catctttctgtcga

SEQ ID NO: 7997 - DNA, 14 bp, Artificial sequence
  synthetic sequence
tggttgcggttata

SEQ ID NO: 7998 - DNA, 14 bp, Artificial sequence
  synthetic sequence
tttacttaacggat

SEQ ID NO: 7999 - DNA, 14 bp, Artificial sequence
  synthetic sequence
ttttgggcgaaatt

SEQ ID NO: 8000 - DNA, 14 bp, Artificial sequence
  synthetic sequence
tacagttcatatgt

SEQ ID NO: 8001 - DNA, 14 bp, Artificial sequence
  synthetic sequence
gtatagccttgatt

SEQ ID NO: 8002 - DNA, 14 bp, Artificial sequence
  synthetic sequence
ctttgagcggtctt

SEQ ID NO: 8003 - DNA, 14 bp, Artificial sequence
  synthetic sequence
atttgcttaactac

SEQ ID NO: 8004 - DNA, 14 bp, Artificial sequence
  synthetic sequence
tttcgctttccacc

SEQ ID NO: 8005 - DNA, 14 bp, Artificial sequence
  synthetic sequence
aagtatcttgtagt

SEQ ID NO: 8006 - DNA, 14 bp, Artificial sequence
  synthetic sequence
acagtgctttttca

SEQ ID NO: 8007 - DNA, 14 bp, Artificial sequence
  synthetic sequence
gttaccagatgttt

SEQ ID NO: 8008 - DNA, 14 bp, Artificial sequence
  synthetic sequence
gtttgcttcaaatg

SEQ ID NO: 8009 - DNA, 14 bp, Artificial sequence
  synthetic sequence
ttttgcttaccgga

SEQ ID NO: 8010 - DNA, 14 bp, Artificial sequence
  synthetic sequence
taattcatcatcat

SEQ ID NO: 8011 - DNA, 14 bp, Artificial sequence
  synthetic sequence
ctgttctgccttca

SEQ ID NO: 8012 - DNA, 14 bp, Artificial sequence
  synthetic sequence
gggttaatttatgg

SEQ ID NO: 8013 - DNA, 14 bp, Artificial sequence
  synthetic sequence
attgaattctggta

SEQ ID NO: 8014 - DNA, 14 bp, Artificial sequence
  synthetic sequence
tttcgctactcata

SEQ ID NO: 8015 - DNA, 14 bp, Artificial sequence
  synthetic sequence
tggttttatgagcc

SEQ ID NO: 8016 - DNA, 14 bp, Artificial sequence
  synthetic sequence
gtattatcaatcat

SEQ ID NO: 8017 - DNA, 14 bp, Artificial sequence
  synthetic sequence
ttctccactctagt

SEQ ID NO: 8018 - DNA, 14 bp, Artificial sequence
  synthetic sequence
gtcattgagtttac

SEQ ID NO: 8019 - DNA, 14 bp, Artificial sequence
  synthetic sequence
tctgtttgcaagta

SEQ ID NO: 8020 - DNA, 14 bp, Artificial sequence
  synthetic sequence
gctttttcgctgaa

SEQ ID NO: 8021 - DNA, 14 bp, Artificial sequence
  synthetic sequence
agctttgttgagtc

SEQ ID NO: 8022 - DNA, 14 bp, Artificial sequence
  synthetic sequence
gtattttaacctgg

SEQ ID NO: 8023 - DNA, 14 bp, Artificial sequence
  synthetic sequence
ctagtttagttcgg

SEQ ID NO: 8024 - DNA, 14 bp, Artificial sequence
  synthetic sequence
tggcttctgttaag

SEQ ID NO: 8025 - DNA, 14 bp, Artificial sequence
  synthetic sequence
gtgatgtccttact

SEQ ID NO: 8026 - DNA, 14 bp, Artificial sequence
  synthetic sequence
ttttgatccgaggt

SEQ ID NO: 8027 - DNA, 14 bp, Artificial sequence
  synthetic sequence
tgagtttacgttct

SEQ ID NO: 8028 - DNA, 14 bp, Artificial sequence
  synthetic sequence
gcttttattgaatc

SEQ ID NO: 8029 - DNA, 14 bp, Artificial sequence
  synthetic sequence
ctaattttagtcta

SEQ ID NO: 8030 - DNA, 14 bp, Artificial sequence
  synthetic sequence
ataatgtcgttttg

SEQ ID NO: 8031 - DNA, 14 bp, Artificial sequence
  synthetic sequence
tctaattccgttgt

SEQ ID NO: 8032 - DNA, 14 bp, Artificial sequence
  synthetic sequence
ttacgttttgtggc

SEQ ID NO: 8033 - DNA, 14 bp, Artificial sequence
  synthetic sequence
aggtttttgctgat

SEQ ID NO: 8034 - DNA, 14 bp, Artificial sequence
  synthetic sequence
tggctttgtctcat

SEQ ID NO: 8035 - DNA, 14 bp, Artificial sequence
  synthetic sequence
cttccccgtttttc

SEQ ID NO: 8036 - DNA, 14 bp, Artificial sequence
  synthetic sequence
gttgctttttccca

SEQ ID NO: 8037 - DNA, 14 bp, Artificial sequence
  synthetic sequence
ccctattgtgtgtt

SEQ ID NO: 8038 - DNA, 14 bp, Artificial sequence
  synthetic sequence
catgttcgtgtatt

SEQ ID NO: 8039 - DNA, 14 bp, Artificial sequence
  synthetic sequence
ctactctttaatta

SEQ ID NO: 8040 - DNA, 14 bp, Artificial sequence
  synthetic sequence
cattgtatcattta

SEQ ID NO: 8041 - DNA, 14 bp, Artificial sequence
  synthetic sequence
cgtgttctgtggtt

SEQ ID NO: 8042 - DNA, 14 bp, Artificial sequence
  synthetic sequence
tctactgttaatat

SEQ ID NO: 8043 - DNA, 14 bp, Artificial sequence
  synthetic sequence
ttgtgcgatttatg

SEQ ID NO: 8044 - DNA, 14 bp, Artificial sequence
  synthetic sequence
tttctatcgttaaa

SEQ ID NO: 8045 - DNA, 14 bp, Artificial sequence
  synthetic sequence
tttgtcctcggttc

SEQ ID NO: 8046 - DNA, 14 bp, Artificial sequence
  synthetic sequence
ttctcgtctaatat

SEQ ID NO: 8047 - DNA, 14 bp, Artificial sequence
  synthetic sequence
attccttccttgat

SEQ ID NO: 8048 - DNA, 14 bp, Artificial sequence
  synthetic sequence
ccgctaagtttttt

SEQ ID NO: 8049 - DNA, 14 bp, Artificial sequence
  synthetic sequence
ctgatttatgttgg

SEQ ID NO: 8050 - DNA, 14 bp, Artificial sequence
  synthetic sequence
tttcatagatgtat

SEQ ID NO: 8051 - DNA, 14 bp, Artificial sequence
  synthetic sequence
tttcttgggacttc

SEQ ID NO: 8052 - DNA, 14 bp, Artificial sequence
  synthetic sequence
cgtgtgtttgactt

SEQ ID NO: 8053 - DNA, 14 bp, Artificial sequence
  synthetic sequence
gtcccttcttttcc

SEQ ID NO: 8054 - DNA, 14 bp, Artificial sequence
  synthetic sequence
agttatactttggt

SEQ ID NO: 8055 - DNA, 14 bp, Artificial sequence
  synthetic sequence
gtggtagtttctgt

SEQ ID NO: 8056 - DNA, 14 bp, Artificial sequence
  synthetic sequence
tgggctttagttat

SEQ ID NO: 8057 - DNA, 14 bp, Artificial sequence
  synthetic sequence
accttgcttgttgt

SEQ ID NO: 8058 - DNA, 14 bp, Artificial sequence
  synthetic sequence
gtgtaaactttctt

SEQ ID NO: 8059 - DNA, 14 bp, Artificial sequence
  synthetic sequence
ttctgactgttgtc

SEQ ID NO: 8060 - DNA, 14 bp, Artificial sequence
  synthetic sequence
ctgttgtcttgagt

SEQ ID NO: 8061 - DNA, 14 bp, Artificial sequence
  synthetic sequence
tttgccatactgtt

SEQ ID NO: 8062 - DNA, 14 bp, Artificial sequence
  synthetic sequence
ttccccatgtttgt

SEQ ID NO: 8063 - DNA, 14 bp, Artificial sequence
  synthetic sequence
ttatcatctatcta

SEQ ID NO: 8064 - DNA, 14 bp, Artificial sequence
  synthetic sequence
tagtttcttgcgtc

SEQ ID NO: 8065 - DNA, 14 bp, Artificial sequence
  synthetic sequence
ttgggtgttactta

SEQ ID NO: 8066 - DNA, 14 bp, Artificial sequence
  synthetic sequence
tgttctttgcataa

SEQ ID NO: 8067 - DNA, 14 bp, Artificial sequence
  synthetic sequence
ctttctctaaaatt

SEQ ID NO: 8068 - DNA, 14 bp, Artificial sequence
  synthetic sequence
tgatatagattgtt

SEQ ID NO: 8069 - DNA, 14 bp, Artificial sequence
  synthetic sequence
ttactcgtgttatc

SEQ ID NO: 8070 - DNA, 14 bp, Artificial sequence
  synthetic sequence
aattttctaccatt

SEQ ID NO: 8071 - DNA, 14 bp, Artificial sequence
  synthetic sequence
tgtttgttactcgc

SEQ ID NO: 8072 - DNA, 14 bp, Artificial sequence
  synthetic sequence
tccgtactatattt

SEQ ID NO: 8073 - DNA, 14 bp, Artificial sequence
  synthetic sequence
ctactttagtgtct

SEQ ID NO: 8074 - DNA, 14 bp, Artificial sequence
  synthetic sequence
tcctgctttattaa

SEQ ID NO: 8075 - DNA, 14 bp, Artificial sequence
  synthetic sequence
ttattcaggtgttc

SEQ ID NO: 8076 - DNA, 14 bp, Artificial sequence
  synthetic sequence
tcagtctttttgcc

SEQ ID NO: 8077 - DNA, 14 bp, Artificial sequence
  synthetic sequence
ttatcctttcaact

SEQ ID NO: 8078 - DNA, 14 bp, Artificial sequence
  synthetic sequence
tgctttatctctgg

SEQ ID NO: 8079 - DNA, 14 bp, Artificial sequence
  synthetic sequence
ctccttctttgtaa

SEQ ID NO: 8080 - DNA, 14 bp, Artificial sequence
  synthetic sequence
tcagtttcttgagt

SEQ ID NO: 8081 - DNA, 14 bp, Artificial sequence
  synthetic sequence
ctcacttcttgtat

SEQ ID NO: 8082 - DNA, 14 bp, Artificial sequence
  synthetic sequence
tttcatcgtgttcg

SEQ ID NO: 8083 - DNA, 14 bp, Artificial sequence
  synthetic sequence
tcagagtgttttat

SEQ ID NO: 8084 - DNA, 14 bp, Artificial sequence
  synthetic sequence
tagttttcgttacc

SEQ ID NO: 8085 - DNA, 19 bp, Artificial sequence
  synthetic sequence
ctggagagtcacgcccaca

SEQ ID NO: 8086 - DNA, 20 bp, Artificial sequence
  synthetic sequence
ctggggctgacaggcaacca

SEQ ID NO: 8087 - DNA, 22 bp, Artificial sequence
  synthetic sequence
ccacacaggggaggtgatagca

SEQ ID NO: 8088 - DNA, 18 bp, Artificial sequence
  synthetic sequence
ctgggcacaaccacagga

SEQ ID NO: 8089 - DNA, 17 bp, Artificial sequence
  synthetic sequence
gtgaaccggcgagcaca

SEQ ID NO: 8090 - DNA, 20 bp, Artificial sequence
  synthetic sequence
gtgcacttaaggacagccga

SEQ ID NO: 8091 - DNA, 22 bp, Artificial sequence
  synthetic sequence
acgtcatccagcagagaatgga

SEQ ID NO: 8092 - DNA, 22 bp, Artificial sequence
  synthetic sequence
aacacaggcttcacagtggcaa

SEQ ID NO: 8093 - DNA, 18 bp, Artificial sequence
  synthetic sequence
tgggcagaatcccacaga

SEQ ID NO: 8094 - DNA, 18 bp, Artificial sequence
  synthetic sequence
ggatctgaagccccagca

SEQ ID NO: 8095 - DNA, 20 bp, Artificial sequence
  synthetic sequence
cggtaccagcggaagtggga

SEQ ID NO: 8096 - DNA, 20 bp, Artificial sequence
  synthetic sequence
ctcggatccacagcagccca

SEQ ID NO: 8097 - DNA, 18 bp, Artificial sequence
  synthetic sequence
cccctcagtgctacccca

SEQ ID NO: 8098 - DNA, 20 bp, Artificial sequence
  synthetic sequence
gaaccacacagcaaacccca

SEQ ID NO: 8099 - DNA, 18 bp, Artificial sequence
  synthetic sequence
taaccagcaggcccacca

SEQ ID NO: 8100 - DNA, 20 bp, Artificial sequence
  synthetic sequence
ctggacaagagccatgacca

SEQ ID NO: 8101 - DNA, 18 bp, Artificial sequence
  synthetic sequence
catctgcagagtggccga

SEQ ID NO: 8102 - DNA, 18 bp, Artificial sequence
  synthetic sequence
tccgtgtacgcaaggcca

SEQ ID NO: 8103 - DNA, 22 bp, Artificial sequence
  synthetic sequence
tgcatcctgctgaggaaggaga

SEQ ID NO: 8104 - DNA, 19 bp, Artificial sequence
  synthetic sequence
cgggcaccagtactcagca

SEQ ID NO: 8105 - DNA, 22 bp, Artificial sequence
  synthetic sequence
atctgcaatgtaagcggggaga

SEQ ID NO: 8106 - DNA, 21 bp, Artificial sequence
  synthetic sequence
tcagtccaaagcctcaaagga

SEQ ID NO: 8107 - DNA, 20 bp, Artificial sequence
  synthetic sequence
gagtggctcaagacccagga

SEQ ID NO: 8108 - DNA, 22 bp, Artificial sequence
  synthetic sequence
agaaaagaaggatcccagcgca

SEQ ID NO: 8109 - DNA, 18 bp, Artificial sequence
  synthetic sequence
ccatctggaaccgggaca

SEQ ID NO: 8110 - DNA, 20 bp, Artificial sequence
  synthetic sequence
ctgggctacactgagcacca

SEQ ID NO: 8111 - DNA, 18 bp, Artificial sequence
  synthetic sequence
gatggccaacaccccaga

SEQ ID NO: 8112 - DNA, 21 bp, Artificial sequence
  synthetic sequence
gcaagacagtgggctggtgaa

SEQ ID NO: 8113 - DNA, 18 bp, Artificial sequence
  synthetic sequence
cctcagcatccgagggca

SEQ ID NO: 8114 - DNA, 22 bp, Artificial sequence
  synthetic sequence
tctggagtctagacggctcaga

SEQ ID NO: 8115 - DNA, 21 bp, Artificial sequence
  synthetic sequence
atgaccagtcaacaggggaca

SEQ ID NO: 8116 - DNA, 20 bp, Artificial sequence
  synthetic sequence
ccagacccactccaaccgca

SEQ ID NO: 8117 - DNA, 21 bp, Artificial sequence
  synthetic sequence
aaaatacagcccgaactgcaa

SEQ ID NO: 8118 - DNA, 21 bp, Artificial sequence
  synthetic sequence
gacccgagaacctcacagaga

SEQ ID NO: 8119 - DNA, 21 bp, Artificial sequence
  synthetic sequence
gaagcaaggaagagcaggaga

SEQ ID NO: 8120 - DNA, 19 bp, Artificial sequence
  synthetic sequence
gagagactcggctgcagga

SEQ ID NO: 8121 - DNA, 21 bp, Artificial sequence
  synthetic sequence
cacccacaactaccctagcca

SEQ ID NO: 8122 - DNA, 19 bp, Artificial sequence
  synthetic sequence
cacccctcacggctgcaga

SEQ ID NO: 8123 - DNA, 19 bp, Artificial sequence
  synthetic sequence
ctgttgctcgggcagccca

SEQ ID NO: 8124 - DNA, 18 bp, Artificial sequence
  synthetic sequence
gatggaagctgcacgcca

SEQ ID NO: 8125 - DNA, 19 bp, Artificial sequence
  synthetic sequence
cggagctcatgtgccagga

SEQ ID NO: 8126 - DNA, 20 bp, Artificial sequence
  synthetic sequence
ctgcttggacaatggagcca

SEQ ID NO: 8127 - DNA, 18 bp, Artificial sequence
  synthetic sequence
cagtatcccgcaccccaa

SEQ ID NO: 8128 - DNA, 20 bp, Artificial sequence
  synthetic sequence
tgggtcactggacccaccaa

SEQ ID NO: 8129 - DNA, 18 bp, Artificial sequence
  synthetic sequence
gcatggagatccccacca

SEQ ID NO: 8130 - DNA, 20 bp, Artificial sequence
  synthetic sequence
gcagagggttaaggcgcaga

SEQ ID NO: 8131 - DNA, 20 bp, Artificial sequence
  synthetic sequence
ctgcaccggagaattcagga

SEQ ID NO: 8132 - DNA, 20 bp, Artificial sequence
  synthetic sequence
cacactgcgctacaggagga

SEQ ID NO: 8133 - DNA, 20 bp, Artificial sequence
  synthetic sequence
aagttcgcccgcagctcaca

SEQ ID NO: 8134 - DNA, 21 bp, Artificial sequence
  synthetic sequence
ccacaaaaccaagcgaggcca

SEQ ID NO: 8135 - DNA, 19 bp, Artificial sequence
  synthetic sequence
gtggccgcaaagaagacga

SEQ ID NO: 8136 - DNA, 22 bp, Artificial sequence
  synthetic sequence
agatctatgaaggccaagtgga

SEQ ID NO: 8137 - DNA, 21 bp, Artificial sequence
  synthetic sequence
ctcccacaaccctgagaccaa

SEQ ID NO: 8138 - DNA, 18 bp, Artificial sequence
  synthetic sequence
tcactgtgccagcccaga

SEQ ID NO: 8139 - DNA, 19 bp, Artificial sequence
  synthetic sequence
ggaagctgaaagtccccga

SEQ ID NO: 8140 - DNA, 18 bp, Artificial sequence
  synthetic sequence
atacccactggcggcaca

SEQ ID NO: 8141 - DNA, 19 bp, Artificial sequence
  synthetic sequence
gggaagcgtgttgcaagaa

SEQ ID NO: 8142 - DNA, 19 bp, Artificial sequence
  synthetic sequence
ccaaagccttccagcgaca

SEQ ID NO: 8143 - DNA, 21 bp, Artificial sequence
  synthetic sequence
ttgcacctggggaatgggaga

SEQ ID NO: 8144 - DNA, 18 bp, Artificial sequence
  synthetic sequence
ccacgccagcttcggaga

SEQ ID NO: 8145 - DNA, 18 bp, Artificial sequence
  synthetic sequence
ggcacgagcagctgcaga

SEQ ID NO: 8146 - DNA, 18 bp, Artificial sequence
  synthetic sequence
cgatgcttggcctaccga

SEQ ID NO: 8147 - DNA, 19 bp, Artificial sequence
  synthetic sequence
cccccctgagatctgagga

SEQ ID NO: 8148 - DNA, 20 bp, Artificial sequence
  synthetic sequence
tagactatgaggccggcaca

SEQ ID NO: 8149 - DNA, 19 bp, Artificial sequence
  synthetic sequence
ccctccagccacttcccca

SEQ ID NO: 8150 - DNA, 18 bp, Artificial sequence
  synthetic sequence
gctctcacagtgccggaa

SEQ ID NO: 8151 - DNA, 20 bp, Artificial sequence
  synthetic sequence
gaggaggagggcgaggacga

SEQ ID NO: 8152 - DNA, 20 bp, Artificial sequence
  synthetic sequence
catccctcctgaccagcaga

SEQ ID NO: 8153 - DNA, 18 bp, Artificial sequence
  synthetic sequence
ggcacatgtgtctcccca

SEQ ID NO: 8154 - DNA, 20 bp, Artificial sequence
  synthetic sequence
gaccgacaaggctgcaggaa

SEQ ID NO: 8155 - DNA, 23 bp, Artificial sequence
  synthetic sequence
aaaaaacagcagatggctcgaga

SEQ ID NO: 8156 - DNA, 18 bp, Artificial sequence
  synthetic sequence
cctgcaaagccttcccca

SEQ ID NO: 8157 - DNA, 18 bp, Artificial sequence
  synthetic sequence
catcagcgcgtccacaca

SEQ ID NO: 8158 - DNA, 18 bp, Artificial sequence
  synthetic sequence
gcaggctgtgggaaggca

SEQ ID NO: 8159 - DNA, 20 bp, Artificial sequence
  synthetic sequence
cactacctggggaagaccca

SEQ ID NO: 8160 - DNA, 18 bp, Artificial sequence
  synthetic sequence
cttcagcagcacacccga

SEQ ID NO: 8161 - DNA, 22 bp, Artificial sequence
  synthetic sequence
cagttcctgaacacggaaggaa

SEQ ID NO: 8162 - DNA, 20 bp, Artificial sequence
  synthetic sequence
gggggacacattggccagca

SEQ ID NO: 8163 - DNA, 18 bp, Artificial sequence
  synthetic sequence
agggctgaggaaagggga

SEQ ID NO: 8164 - DNA, 18 bp, Artificial sequence
  synthetic sequence
tccgagcacacctgggca

SEQ ID NO: 8165 - DNA, 20 bp, Artificial sequence
  synthetic sequence
caacgggactcaggagcaca

SEQ ID NO: 8166 - DNA, 18 bp, Artificial sequence
  synthetic sequence
gcactggccatagcagca

SEQ ID NO: 8167 - DNA, 18 bp, Artificial sequence
  synthetic sequence
agatggacgcactgggca

SEQ ID NO: 8168 - DNA, 18 bp, Artificial sequence
  synthetic sequence
gggaggtgttcttcgcca

SEQ ID NO: 8169 - DNA, 18 bp, Artificial sequence
  synthetic sequence
ttccaggagctgcagcca

SEQ ID NO: 8170 - DNA, 18 bp, Artificial sequence
  synthetic sequence
tgccccacggctacgaga

SEQ ID NO: 8171 - DNA, 18 bp, Artificial sequence
  synthetic sequence
tggcagaagccctggcaa

SEQ ID NO: 8172 - DNA, 18 bp, Artificial sequence
  synthetic sequence
aggagtggctgatcggca

SEQ ID NO: 8173 - DNA, 20 bp, Artificial sequence
  synthetic sequence
aaggaggggatgctacagca

SEQ ID NO: 8174 - DNA, 18 bp, Artificial sequence
  synthetic sequence
tgatcagctggagggcga

SEQ ID NO: 8175 - DNA, 18 bp, Artificial sequence
  synthetic sequence
agccattgcccatcgaga

SEQ ID NO: 8176 - DNA, 21 bp, Artificial sequence
  synthetic sequence
agttacacctaagccacccta

SEQ ID NO: 8177 - DNA, 20 bp, Artificial sequence
  synthetic sequence
acggacaggtaggcacgaga

SEQ ID NO: 8178 - DNA, 21 bp, Artificial sequence
  synthetic sequence
aatgcaaactgaaacctggga

SEQ ID NO: 8179 - DNA, 18 bp, Artificial sequence
  synthetic sequence
ccgccagattcctaccca

SEQ ID NO: 8180 - DNA, 20 bp, Artificial sequence
  synthetic sequence
caaccagctccctgaccaca

SEQ ID NO: 8181 - DNA, 18 bp, Artificial sequence
  synthetic sequence
ctgcgagagggaacagca

SEQ ID NO: 8182 - DNA, 18 bp, Artificial sequence
  synthetic sequence
ccgcccttctgcaacaca

SEQ ID NO: 8183 - DNA, 19 bp, Artificial sequence
  synthetic sequence
gatagtggaagccacccca

SEQ ID NO: 8184 - DNA, 18 bp, Artificial sequence
  synthetic sequence
gagcagactgcaccccaa

SEQ ID NO: 8185 - DNA, 18 bp, Artificial sequence
  synthetic sequence
acccttgctgcgaaggaa

SEQ ID NO: 8186 - DNA, 18 bp, Artificial sequence
  synthetic sequence
cggaaagagcttccggga

SEQ ID NO: 8187 - DNA, 19 bp, Artificial sequence
  synthetic sequence
ggggaacctcactgaccga

SEQ ID NO: 8188 - DNA, 19 bp, Artificial sequence
  synthetic sequence
cctctggcacagaacccca

SEQ ID NO: 8189 - DNA, 18 bp, Artificial sequence
  synthetic sequence
cgtggcaacagctcgaca

SEQ ID NO: 8190 - DNA, 21 bp, Artificial sequence
  synthetic sequence
tcttcctcgccggtatacaca

SEQ ID NO: 8191 - DNA, 18 bp, Artificial sequence
  synthetic sequence
ccctccggaacacaagga

SEQ ID NO: 8192 - DNA, 19 bp, Artificial sequence
  synthetic sequence
ctggccgccttcacctgga

SEQ ID NO: 8193 - DNA, 18 bp, Artificial sequence
  synthetic sequence
ggcagcaccacctgccaa

SEQ ID NO: 8194 - DNA, 20 bp, Artificial sequence
  synthetic sequence
aagacatcgtgacgtgccaa

SEQ ID NO: 8195 - DNA, 22 bp, Artificial sequence
  synthetic sequence
ccatgcaagcaggagaagagca

SEQ ID NO: 8196 - DNA, 19 bp, Artificial sequence
  synthetic sequence
gggtgtgagaccgtcagga

SEQ ID NO: 8197 - DNA, 21 bp, Artificial sequence
  synthetic sequence
acatggatgggcctagaagca

SEQ ID NO: 8198 - DNA, 20 bp, Artificial sequence
  synthetic sequence
ctggatggggctagaagcaa

SEQ ID NO: 8199 - DNA, 19 bp, Artificial sequence
  synthetic sequence
tctcatggcccacagggaa

SEQ ID NO: 8200 - DNA, 20 bp, Artificial sequence
  synthetic sequence
atctaagcccagccgtggta

SEQ ID NO: 8201 - DNA, 18 bp, Artificial sequence
  synthetic sequence
ccaggccgtgatggcaga

SEQ ID NO: 8202 - DNA, 18 bp, Artificial sequence
  synthetic sequence
ccaagtcgctggccctca

SEQ ID NO: 8203 - DNA, 18 bp, Artificial sequence
  synthetic sequence
ggtgctccgtgccacgca

SEQ ID NO: 8204 - DNA, 19 bp, Artificial sequence
  synthetic sequence
ccatcagcctggaccgcta

SEQ ID NO: 8205 - DNA, 18 bp, Artificial sequence
  synthetic sequence
ccacccaccaggaagcca

SEQ ID NO: 8206 - DNA, 18 bp, Artificial sequence
  synthetic sequence
tccccattgccaacgcca

SEQ ID NO: 8207 - DNA, 20 bp, Artificial sequence
  synthetic sequence
cagggtctcactggagcgaa

SEQ ID NO: 8208 - DNA, 17 bp, Artificial sequence
  synthetic sequence
cccgccttcgacgcaca

SEQ ID NO: 8209 - DNA, 22 bp, Artificial sequence
  synthetic sequence
ataacccgtgaccaagtcctga

SEQ ID NO: 8210 - DNA, 18 bp, Artificial sequence
  synthetic sequence
agctggctcacccccaga

SEQ ID NO: 8211 - DNA, 20 bp, Artificial sequence
  synthetic sequence
atgcagccaccatgaagaca

SEQ ID NO: 8212 - DNA, 18 bp, Artificial sequence
  synthetic sequence
ttggtgaacaggcgacca

SEQ ID NO: 8213 - DNA, 20 bp, Artificial sequence
  synthetic sequence
acacgatgaggcagacgaga

SEQ ID NO: 8214 - DNA, 21 bp, Artificial sequence
  synthetic sequence
caaagaaggagccacacgaca

SEQ ID NO: 8215 - DNA, 18 bp, Artificial sequence
  synthetic sequence
tgcatgaggcggtggaga

SEQ ID NO: 8216 - DNA, 18 bp, Artificial sequence
  synthetic sequence
acagccaaggtgggacca

SEQ ID NO: 8217 - DNA, 18 bp, Artificial sequence
  synthetic sequence
ctgccagggcaacgggaa

SEQ ID NO: 8218 - DNA, 18 bp, Artificial sequence
  synthetic sequence
gcaggtgcaggtcgagga

SEQ ID NO: 8219 - DNA, 18 bp, Artificial sequence
  synthetic sequence
gactccatgcccctgcaa

SEQ ID NO: 8220 - DNA, 21 bp, Artificial sequence
  synthetic sequence
caactggagctgatggacaca

SEQ ID NO: 8221 - DNA, 20 bp, Artificial sequence
  synthetic sequence
caagcaaaagaagctgggca

SEQ ID NO: 8222 - DNA, 19 bp, Artificial sequence
  synthetic sequence
tcaccaccctggacagaga

SEQ ID NO: 8223 - DNA, 18 bp, Artificial sequence
  synthetic sequence
gggacaagaactgcgcca

SEQ ID NO: 8224 - DNA, 22 bp, Artificial sequence
  synthetic sequence
aaaccacactgcaccttcggaa

SEQ ID NO: 8225 - DNA, 22 bp, Artificial sequence
  synthetic sequence
gaaagcccaagacattggagca

SEQ ID NO: 8226 - DNA, 22 bp, Artificial sequence
  synthetic sequence
atccagtacggcttcaccacca

SEQ ID NO: 8227 - DNA, 20 bp, Artificial sequence
  synthetic sequence
gactcagatgccgaggtgga

SEQ ID NO: 8228 - DNA, 19 bp, Artificial sequence
  synthetic sequence
gctacaccctgaacccgga

SEQ ID NO: 8229 - DNA, 19 bp, Artificial sequence
  synthetic sequence
gggagaaaagggctccaca

SEQ ID NO: 8230 - DNA, 18 bp, Artificial sequence
  synthetic sequence
tcaacggtcagaggccca

SEQ ID NO: 8231 - DNA, 18 bp, Artificial sequence
  synthetic sequence
gttacgcaccaccgggga

SEQ ID NO: 8232 - DNA, 18 bp, Artificial sequence
  synthetic sequence
ccgagaaggcacagcaga

SEQ ID NO: 8233 - DNA, 18 bp, Artificial sequence
  synthetic sequence
ctcgaggaagagcgggaa

SEQ ID NO: 8234 - DNA, 18 bp, Artificial sequence
  synthetic sequence
ctgacctgcgcaacgaga

SEQ ID NO: 8235 - DNA, 21 bp, Artificial sequence
  synthetic sequence
gccaccccagttaacctcaca

SEQ ID NO: 8236 - DNA, 18 bp, Artificial sequence
  synthetic sequence
aggagcaggcccagcaga

SEQ ID NO: 8237 - DNA, 22 bp, Artificial sequence
  synthetic sequence
aatggagccgtacgctatacga

SEQ ID NO: 8238 - DNA, 19 bp, Artificial sequence
  synthetic sequence
ctggctactaccgaccgga

SEQ ID NO: 8239 - DNA, 19 bp, Artificial sequence
  synthetic sequence
cagctgtcgtcactggcaa

SEQ ID NO: 8240 - DNA, 19 bp, Artificial sequence
  synthetic sequence
cggtgtggggaaaagtcca

SEQ ID NO: 8241 - DNA, 21 bp, Artificial sequence
  synthetic sequence
gtcgcatcagtgtcaggagga

SEQ ID NO: 8242 - DNA, 21 bp, Artificial sequence
  synthetic sequence
catggtcaagatccccagcaa

SEQ ID NO: 8243 - DNA, 18 bp, Artificial sequence
  synthetic sequence
ggtgcagccacaccagga

SEQ ID NO: 8244 - DNA, 18 bp, Artificial sequence
  synthetic sequence
ccgatggcaaggagagga

SEQ ID NO: 8245 - DNA, 21 bp, Artificial sequence
  synthetic sequence
ggaatgatccaggccctggga

SEQ ID NO: 8246 - DNA, 18 bp, Artificial sequence
  synthetic sequence
cgctctgaagaaggccga

SEQ ID NO: 8247 - DNA, 19 bp, Artificial sequence
  synthetic sequence
ccccgccaggattaacaca

SEQ ID NO: 8248 - DNA, 21 bp, Artificial sequence
  synthetic sequence
gaatgtgacccccaacgtgga

SEQ ID NO: 8249 - DNA, 20 bp, Artificial sequence
  synthetic sequence
cagagcctggccgagtggaa

SEQ ID NO: 8250 - DNA, 19 bp, Artificial sequence
  synthetic sequence
cagccctctccctggcaga

SEQ ID NO: 8251 - DNA, 21 bp, Artificial sequence
  synthetic sequence
gcttagcctggctcacgcaca

SEQ ID NO: 8252 - DNA, 20 bp, Artificial sequence
  synthetic sequence
ctgcctgaatcagaagggca

SEQ ID NO: 8253 - DNA, 18 bp, Artificial sequence
  synthetic sequence
gagattgcaccagcggca

SEQ ID NO: 8254 - DNA, 19 bp, Artificial sequence
  synthetic sequence
cccagccagaccctaagga

SEQ ID NO: 8255 - DNA, 18 bp, Artificial sequence
  synthetic sequence
agatgcgcagcaccagga

SEQ ID NO: 8256 - DNA, 21 bp, Artificial sequence
  synthetic sequence
atcaccatccttccgcagcaa

SEQ ID NO: 8257 - DNA, 22 bp, Artificial sequence
  synthetic sequence
gccgacagaggcagacacagaa

SEQ ID NO: 8258 - DNA, 18 bp, Artificial sequence
  synthetic sequence
ggattacgacgcggcaga

SEQ ID NO: 8259 - DNA, 19 bp, Artificial sequence
  synthetic sequence
gcacacccgaggaacagga

SEQ ID NO: 8260 - DNA, 18 bp, Artificial sequence
  synthetic sequence
tcctgaggctccagggaa

SEQ ID NO: 8261 - DNA, 19 bp, Artificial sequence
  synthetic sequence
ggggtgaactgggggagga

SEQ ID NO: 8262 - DNA, 18 bp, Artificial sequence
  synthetic sequence
gttcaaccggccagccaa

SEQ ID NO: 8263 - DNA, 18 bp, Artificial sequence
  synthetic sequence
ccagaaagttcggcccaa

SEQ ID NO: 8264 - DNA, 19 bp, Artificial sequence
  synthetic sequence
ccaggagggaggtgtgtga

SEQ ID NO: 8265 - DNA, 19 bp, Artificial sequence
  synthetic sequence
cgggcctactacaacggca

SEQ ID NO: 8266 - DNA, 18 bp, Artificial sequence
  synthetic sequence
agggatgagcaaccccga

SEQ ID NO: 8267 - DNA, 18 bp, Artificial sequence
  synthetic sequence
cattgcccaagcccgcaa

SEQ ID NO: 8268 - DNA, 18 bp, Artificial sequence
  synthetic sequence
gggcacctcatcacacga

SEQ ID NO: 8269 - DNA, 22 bp, Artificial sequence
  synthetic sequence
ctgccacaacccaatatgccaa

SEQ ID NO: 8270 - DNA, 20 bp, Artificial sequence
  synthetic sequence
catccgggggcagctctgga

SEQ ID NO: 8271 - DNA, 18 bp, Artificial sequence
  synthetic sequence
cgtggaccacagcaccca

SEQ ID NO: 8272 - DNA, 20 bp, Artificial sequence
  synthetic sequence
ctgcaacaagagctgaccga

SEQ ID NO: 8273 - DNA, 18 bp, Artificial sequence
  synthetic sequence
tggctgggagaatgacca

SEQ ID NO: 8274 - DNA, 18 bp, Artificial sequence
  synthetic sequence
cgaccctccaaggacgaa

SEQ ID NO: 8275 - DNA, 18 bp, Artificial sequence
  synthetic sequence
cagcccaggaaaacggca

SEQ ID NO: 8276 - DNA, 22 bp, Artificial sequence
  synthetic sequence
tatcggactctaactgagccca

SEQ ID NO: 8277 - DNA, 18 bp, Artificial sequence
  synthetic sequence
gagaggcggctccgggga

SEQ ID NO: 8278 - DNA, 18 bp, Artificial sequence
  synthetic sequence
agcccactgccctgacca

SEQ ID NO: 8279 - DNA, 21 bp, Artificial sequence
  synthetic sequence
agagtccagcccattgagaga

SEQ ID NO: 8280 - DNA, 20 bp, Artificial sequence
  synthetic sequence
ggcaccggagcaggtagaga

SEQ ID NO: 8281 - DNA, 20 bp, Artificial sequence
  synthetic sequence
aacgtccctagcacgaagca

SEQ ID NO: 8282 - DNA, 18 bp, Artificial sequence
  synthetic sequence
gctggaacgcggacggga

SEQ ID NO: 8283 - DNA, 18 bp, Artificial sequence
  synthetic sequence
acaacggccagtaccgca

SEQ ID NO: 8284 - DNA, 18 bp, Artificial sequence
  synthetic sequence
ccatcaccacgtgggaga

SEQ ID NO: 8285 - DNA, 20 bp, Artificial sequence
  synthetic sequence
gcagcctgtgcccagctcaa

SEQ ID NO: 8286 - DNA, 20 bp, Artificial sequence
  synthetic sequence
cctaggccgacaaaagagga

SEQ ID NO: 8287 - DNA, 18 bp, Artificial sequence
  synthetic sequence
gaggaccacacctgggca

SEQ ID NO: 8288 - DNA, 21 bp, Artificial sequence
  synthetic sequence
ggcctctactcacgctcacga

SEQ ID NO: 8289 - DNA, 18 bp, Artificial sequence
  synthetic sequence
acccctcccacctggaga

SEQ ID NO: 8290 - DNA, 20 bp, Artificial sequence
  synthetic sequence
tactgcacacacatggacga

SEQ ID NO: 8291 - DNA, 20 bp, Artificial sequence
  synthetic sequence
accatgagcccacaggagga

SEQ ID NO: 8292 - DNA, 18 bp, Artificial sequence
  synthetic sequence
gcaggacatcgctcagca

SEQ ID NO: 8293 - DNA, 19 bp, Artificial sequence
  synthetic sequence
gctagtgcagagaccgcga

SEQ ID NO: 8294 - DNA, 18 bp, Artificial sequence
  synthetic sequence
agccatcgggaagcccca

SEQ ID NO: 8295 - DNA, 18 bp, Artificial sequence
  synthetic sequence
ccagaatggccctgacca

SEQ ID NO: 8296 - DNA, 18 bp, Artificial sequence
  synthetic sequence
ggcacctacggctgcaca

SEQ ID NO: 8297 - DNA, 20 bp, Artificial sequence
  synthetic sequence
tgtggtgagggagggagaca

SEQ ID NO: 8298 - DNA, 21 bp, Artificial sequence
  synthetic sequence
ctggctgagtgtggaaaccca

SEQ ID NO: 8299 - DNA, 22 bp, Artificial sequence
  synthetic sequence
aagagcctaagttgccaaagga

SEQ ID NO: 8300 - DNA, 20 bp, Artificial sequence
  synthetic sequence
ggcacttggatccacccaga

SEQ ID NO: 8301 - DNA, 22 bp, Artificial sequence
  synthetic sequence
agaatgggtaaagacagagcga

SEQ ID NO: 8302 - DNA, 20 bp, Artificial sequence
  synthetic sequence
gacgcagagaaacctgagga

SEQ ID NO: 8303 - DNA, 21 bp, Artificial sequence
  synthetic sequence
aaacagttcgacactgaccga

SEQ ID NO: 8304 - DNA, 18 bp, Artificial sequence
  synthetic sequence
tggaaaggctggatgcaa

SEQ ID NO: 8305 - DNA, 18 bp, Artificial sequence
  synthetic sequence
acggcgtgtggaaggtga

SEQ ID NO: 8306 - DNA, 18 bp, Artificial sequence
  synthetic sequence
cagcagccaacaccacca

SEQ ID NO: 8307 - DNA, 20 bp, Artificial sequence
  synthetic sequence
gaggacccaaggagagcaca

SEQ ID NO: 8308 - DNA, 20 bp, Artificial sequence
  synthetic sequence
gctgaggcactgcccgtcaa

SEQ ID NO: 8309 - DNA, 20 bp, Artificial sequence
  synthetic sequence
cagatgcactcaacgtccca

SEQ ID NO: 8310 - DNA, 19 bp, Artificial sequence
  synthetic sequence
ggaccaatgtgggccggga

SEQ ID NO: 8311 - DNA, 18 bp, Artificial sequence
  synthetic sequence
agggctcgctcagccaga

SEQ ID NO: 8312 - DNA, 18 bp, Artificial sequence
  synthetic sequence
gcgccaacatggaagaca

SEQ ID NO: 8313 - DNA, 22 bp, Artificial sequence
  synthetic sequence
gagaccaaaccagaaacctcca

SEQ ID NO: 8314 - DNA, 18 bp, Artificial sequence
  synthetic sequence
ggtgatcgcctacacgca

SEQ ID NO: 8315 - DNA, 18 bp, Artificial sequence
  synthetic sequence
tctactggctgcgcgcga

SEQ ID NO: 8316 - DNA, 19 bp, Artificial sequence
  synthetic sequence
taccaacgagagcggtgaa

SEQ ID NO: 8317 - DNA, 18 bp, Artificial sequence
  synthetic sequence
gctgcatgaacccggtga

SEQ ID NO: 8318 - DNA, 22 bp, Artificial sequence
  synthetic sequence
tgatcatcaggaccttgcagca

SEQ ID NO: 8319 - DNA, 20 bp, Artificial sequence
  synthetic sequence
gtttgcgtctctcccaggaa

SEQ ID NO: 8320 - DNA, 21 bp, Artificial sequence
  synthetic sequence
gcatggaccggtacatcgcca

SEQ ID NO: 8321 - DNA, 18 bp, Artificial sequence
  synthetic sequence
ggcccagacggtggccaa

SEQ ID NO: 8322 - DNA, 20 bp, Artificial sequence
  synthetic sequence
tgatgagccgtcagccgcaa

SEQ ID NO: 8323 - DNA, 19 bp, Artificial sequence
  synthetic sequence
gctccaagccttccaacca

SEQ ID NO: 8324 - DNA, 18 bp, Artificial sequence
  synthetic sequence
cgctgcgcaacacaggaa

SEQ ID NO: 8325 - DNA, 20 bp, Artificial sequence
  synthetic sequence
ctggcgagacagtgagtgga

SEQ ID NO: 8326 - DNA, 21 bp, Artificial sequence
  synthetic sequence
gggaactacacagtgacggga

SEQ ID NO: 8327 - DNA, 20 bp, Artificial sequence
  synthetic sequence
atgggagaagagactggcca

SEQ ID NO: 8328 - DNA, 18 bp, Artificial sequence
  synthetic sequence
agcacccgaacgtgacga

SEQ ID NO: 8329 - DNA, 19 bp, Artificial sequence
  synthetic sequence
ccccgaatgacctgcccca

SEQ ID NO: 8330 - DNA, 20 bp, Artificial sequence
  synthetic sequence
taagccacaacagcctgaca

SEQ ID NO: 8331 - DNA, 18 bp, Artificial sequence
  synthetic sequence
accgtggcaacctgacca

SEQ ID NO: 8332 - DNA, 18 bp, Artificial sequence
  synthetic sequence
gcggcaagtgaagcccga

SEQ ID NO: 8333 - DNA, 20 bp, Artificial sequence
  synthetic sequence
ttgagatccagggcatagca

SEQ ID NO: 8334 - DNA, 19 bp, Artificial sequence
  synthetic sequence
gaacaggagcaactgggca

SEQ ID NO: 8335 - DNA, 18 bp, Artificial sequence
  synthetic sequence
gcactcagccaggggaca

SEQ ID NO: 8336 - DNA, 20 bp, Artificial sequence
  synthetic sequence
gggaagtcagcagagggaga

SEQ ID NO: 8337 - DNA, 21 bp, Artificial sequence
  synthetic sequence
cagcagggaacaaagtcagca

SEQ ID NO: 8338 - DNA, 21 bp, Artificial sequence
  synthetic sequence
tgtctcacccaaatgggacca

SEQ ID NO: 8339 - DNA, 20 bp, Artificial sequence
  synthetic sequence
gaggccagccttcctgcaca

SEQ ID NO: 8340 - DNA, 21 bp, Artificial sequence
  synthetic sequence
gacctcagagagtgagcagga

SEQ ID NO: 8341 - DNA, 18 bp, Artificial sequence
  synthetic sequence
ccagcggaactggcacga

SEQ ID NO: 8342 - DNA, 18 bp, Artificial sequence
  synthetic sequence
ctgtgagagcgacgccaa

SEQ ID NO: 8343 - DNA, 18 bp, Artificial sequence
  synthetic sequence
gatcgggacccagcagga

SEQ ID NO: 8344 - DNA, 17 bp, Artificial sequence
  synthetic sequence
gggacatgggcagagca

SEQ ID NO: 8345 - DNA, 21 bp, Artificial sequence
  synthetic sequence
ccaggaagtctggatccagga

SEQ ID NO: 8346 - DNA, 21 bp, Artificial sequence
  synthetic sequence
gaagttcagcaggagcgcaga

SEQ ID NO: 8347 - DNA, 18 bp, Artificial sequence
  synthetic sequence
acccactggccaccccaa

SEQ ID NO: 8348 - DNA, 21 bp, Artificial sequence
  synthetic sequence
gtggtgccgactacaagcgaa

SEQ ID NO: 8349 - DNA, 18 bp, Artificial sequence
  synthetic sequence
gcagatggccaacgagca

SEQ ID NO: 8350 - DNA, 17 bp, Artificial sequence
  synthetic sequence
ggtgaagcagtcgccca

SEQ ID NO: 8351 - DNA, 20 bp, Artificial sequence
  synthetic sequence
cgaaacctcagcaccgggga

SEQ ID NO: 8352 - DNA, 18 bp, Artificial sequence
  synthetic sequence
agcagaaagcagccggga

SEQ ID NO: 8353 - DNA, 20 bp, Artificial sequence
  synthetic sequence
ctgcacatcaagacaggtga

SEQ ID NO: 8354 - DNA, 18 bp, Artificial sequence
  synthetic sequence
agacgccaggaggaggga

SEQ ID NO: 8355 - DNA, 18 bp, Artificial sequence
  synthetic sequence
gacctccagctgtgcgga

SEQ ID NO: 8356 - DNA, 18 bp, Artificial sequence
  synthetic sequence
aacccaggacgctgagga

SEQ ID NO: 8357 - DNA, 18 bp, Artificial sequence
  synthetic sequence
cttgtcggcgaccaacga

SEQ ID NO: 8358 - DNA, 18 bp, Artificial sequence
  synthetic sequence
cacaggtccagcgggaca

SEQ ID NO: 8359 - DNA, 18 bp, Artificial sequence
  synthetic sequence
tggacctgggaaaacgca

SEQ ID NO: 8360 - DNA, 20 bp, Artificial sequence
  synthetic sequence
ccaagcctgtgacacgagga

SEQ ID NO: 8361 - DNA, 18 bp, Artificial sequence
  synthetic sequence
ccaaggaccctcgaggga

SEQ ID NO: 8362 - DNA, 20 bp, Artificial sequence
  synthetic sequence
ctgctgagtgactcgggaca

SEQ ID NO: 8363 - DNA, 19 bp, Artificial sequence
  synthetic sequence
tggacaagctgtgagacca

SEQ ID NO: 8364 - DNA, 21 bp, Artificial sequence
  synthetic sequence
tcagagctgcaaatacccaca

SEQ ID NO: 8365 - DNA, 20 bp, Artificial sequence
  synthetic sequence
tcagtcacagacctgcccaa

SEQ ID NO: 8366 - DNA, 18 bp, Artificial sequence
  synthetic sequence
ggagcggtaagcccccaa

SEQ ID NO: 8367 - DNA, 21 bp, Artificial sequence
  synthetic sequence
tgctgcggatcagctcagcta

SEQ ID NO: 8368 - DNA, 23 bp, Artificial sequence
  synthetic sequence
gaaagaggacaacagcacctaca

SEQ ID NO: 8369 - DNA, 20 bp, Artificial sequence
  synthetic sequence
cagcagcatctgtgaaggca

SEQ ID NO: 8370 - DNA, 20 bp, Artificial sequence
  synthetic sequence
ggacaaaacgacaccagcca

SEQ ID NO: 8371 - DNA, 18 bp, Artificial sequence
  synthetic sequence
agcgtgggactccatcca

SEQ ID NO: 8372 - DNA, 19 bp, Artificial sequence
  synthetic sequence
catgccctaatccgggaga

SEQ ID NO: 8373 - DNA, 18 bp, Artificial sequence
  synthetic sequence
cagaggccggcccgacga

SEQ ID NO: 8374 - DNA, 18 bp, Artificial sequence
  synthetic sequence
acaacccgcttgagggaa

SEQ ID NO: 8375 - DNA, 19 bp, Artificial sequence
  synthetic sequence
gccacccttggaggaagga

SEQ ID NO: 8376 - DNA, 19 bp, Artificial sequence
  synthetic sequence
tcaacgagaaggcgatcca

SEQ ID NO: 8377 - DNA, 18 bp, Artificial sequence
  synthetic sequence
cttcccccacgcagcaca

SEQ ID NO: 8378 - DNA, 19 bp, Artificial sequence
  synthetic sequence
caatgccatcagacagcca

SEQ ID NO: 8379 - DNA, 19 bp, Artificial sequence
  synthetic sequence
tctcagggtcccaggacaa

SEQ ID NO: 8380 - DNA, 20 bp, Artificial sequence
  synthetic sequence
gcatggaccagagctggaca

SEQ ID NO: 8381 - DNA, 18 bp, Artificial sequence
  synthetic sequence
gcagctccagcagacgaa

SEQ ID NO: 8382 - DNA, 18 bp, Artificial sequence
  synthetic sequence
ccccggagagcaagtgca

SEQ ID NO: 8383 - DNA, 20 bp, Artificial sequence
  synthetic sequence
ggcaacgagtcataccagca

SEQ ID NO: 8384 - DNA, 18 bp, Artificial sequence
  synthetic sequence
ggacgagaatccccagca

SEQ ID NO: 8385 - DNA, 18 bp, Artificial sequence
  synthetic sequence
agctggcacaaactcgca

SEQ ID NO: 8386 - DNA, 21 bp, Artificial sequence
  synthetic sequence
ctatgaccaggccctacagca

SEQ ID NO: 8387 - DNA, 18 bp, Artificial sequence
  synthetic sequence
tgcaggagaacctgggca

SEQ ID NO: 8388 - DNA, 19 bp, Artificial sequence
  synthetic sequence
cccccaatgaaaggcccta

SEQ ID NO: 8389 - DNA, 19 bp, Artificial sequence
  synthetic sequence
tacacgtgtacagcccaga

SEQ ID NO: 8390 - DNA, 18 bp, Artificial sequence
  synthetic sequence
gaagaagcggcctcgcaa

SEQ ID NO: 8391 - DNA, 19 bp, Artificial sequence
  synthetic sequence
gccgagagaacgagggcta

SEQ ID NO: 8392 - DNA, 20 bp, Artificial sequence
  synthetic sequence
gctgaccttcgggaagggaa

SEQ ID NO: 8393 - DNA, 20 bp, Artificial sequence
  synthetic sequence
gaaacgctgaaagccatcca

SEQ ID NO: 8394 - DNA, 18 bp, Artificial sequence
  synthetic sequence
ccagcatccatcacgcca

SEQ ID NO: 8395 - DNA, 18 bp, Artificial sequence
  synthetic sequence
accagcacagccagagca

SEQ ID NO: 8396 - DNA, 18 bp, Artificial sequence
  synthetic sequence
agaaggggaagaggccga

SEQ ID NO: 8397 - DNA, 20 bp, Artificial sequence
  synthetic sequence
ctctaactgcagccccacga

SEQ ID NO: 8398 - DNA, 18 bp, Artificial sequence
  synthetic sequence
gatgcccccaatacccca

SEQ ID NO: 8399 - DNA, 20 bp, Artificial sequence
  synthetic sequence
cagcacaggcacactgacca

SEQ ID NO: 8400 - DNA, 20 bp, Artificial sequence
  synthetic sequence
tctgaacgccggcctgagca

SEQ ID NO: 8401 - DNA, 22 bp, Artificial sequence
  synthetic sequence
cagggaaaccacccatgacgaa

SEQ ID NO: 8402 - DNA, 20 bp, Artificial sequence
  synthetic sequence
cttcggaccagcctagcaga

SEQ ID NO: 8403 - DNA, 21 bp, Artificial sequence
  synthetic sequence
actgtctaccaggcacacaga

SEQ ID NO: 8404 - DNA, 20 bp, Artificial sequence
  synthetic sequence
cacaagcgctgagatcagga

SEQ ID NO: 8405 - DNA, 18 bp, Artificial sequence
  synthetic sequence
cttgagccagctgcagca

SEQ ID NO: 8406 - DNA, 18 bp, Artificial sequence
  synthetic sequence
tgacggtgatcagggcca

SEQ ID NO: 8407 - DNA, 20 bp, Artificial sequence
  synthetic sequence
ggttggagtggcaggaacga

SEQ ID NO: 8408 - DNA, 19 bp, Artificial sequence
  synthetic sequence
gctccgagtccatagccga

SEQ ID NO: 8409 - DNA, 18 bp, Artificial sequence
  synthetic sequence
ctccaacagctcgcgaca

SEQ ID NO: 8410 - DNA, 20 bp, Artificial sequence
  synthetic sequence
gtggactgggagacaagcaa

SEQ ID NO: 8411 - DNA, 18 bp, Artificial sequence
  synthetic sequence
gacgcagacccaagtgca

SEQ ID NO: 8412 - DNA, 18 bp, Artificial sequence
  synthetic sequence
cggttcgagtcccaggaa

SEQ ID NO: 8413 - DNA, 21 bp, Artificial sequence
  synthetic sequence
agcagcagctccagttcccaa

SEQ ID NO: 8414 - DNA, 18 bp, Artificial sequence
  synthetic sequence
gcaacaccaccctcagca

SEQ ID NO: 8415 - DNA, 20 bp, Artificial sequence
  synthetic sequence
ctggcctcaataggaccaca

SEQ ID NO: 8416 - DNA, 18 bp, Artificial sequence
  synthetic sequence
gcccagatgcccccacca

SEQ ID NO: 8417 - DNA, 20 bp, Artificial sequence
  synthetic sequence
ctgtccaggaaccggacaca

SEQ ID NO: 8418 - DNA, 18 bp, Artificial sequence
  synthetic sequence
tgagcggctacagcggaa

SEQ ID NO: 8419 - DNA, 21 bp, Artificial sequence
  synthetic sequence
gcagcctttcacagccagcca

SEQ ID NO: 8420 - DNA, 18 bp, Artificial sequence
  synthetic sequence
aggcgggtgagcaagtga

SEQ ID NO: 8421 - DNA, 21 bp, Artificial sequence
  synthetic sequence
gatcggggaggactctaagca

SEQ ID NO: 8422 - DNA, 19 bp, Artificial sequence
  synthetic sequence
gctacaacccccagccaga

SEQ ID NO: 8423 - DNA, 21 bp, Artificial sequence
  synthetic sequence
aggaggaggacaaccgggaca

SEQ ID NO: 8424 - DNA, 20 bp, Artificial sequence
  synthetic sequence
cagccctctgaacctgagca

SEQ ID NO: 8425 - DNA, 18 bp, Artificial sequence
  synthetic sequence
aagccacagggagcccca

SEQ ID NO: 8426 - DNA, 18 bp, Artificial sequence
  synthetic sequence
acccctgccaggacggga

SEQ ID NO: 8427 - DNA, 18 bp, Artificial sequence
  synthetic sequence
cgactatccctccgggca

SEQ ID NO: 8428 - DNA, 18 bp, Artificial sequence
  synthetic sequence
cataagcaccccagccca

SEQ ID NO: 8429 - DNA, 21 bp, Artificial sequence
  synthetic sequence
ccggtatgacgggagcagtga

SEQ ID NO: 8430 - DNA, 21 bp, Artificial sequence
  synthetic sequence
aacctctccaccacactgcaa

SEQ ID NO: 8431 - DNA, 21 bp, Artificial sequence
  synthetic sequence
gagaagctgggagagacacca

SEQ ID NO: 8432 - DNA, 20 bp, Artificial sequence
  synthetic sequence
ctgcgggatggcagagctga

SEQ ID NO: 8433 - DNA, 19 bp, Artificial sequence
  synthetic sequence
gcatgcccagaaagctgga

SEQ ID NO: 8434 - DNA, 21 bp, Artificial sequence
  synthetic sequence
tcagatccagaaggtcagcga

SEQ ID NO: 8435 - DNA, 20 bp, Artificial sequence
  synthetic sequence
ctgctgcccaaccccttgga

SEQ ID NO: 8436 - DNA, 21 bp, Artificial sequence
  synthetic sequence
tcaacacgccagagaaactga

SEQ ID NO: 8437 - DNA, 21 bp, Artificial sequence
  synthetic sequence
gggatagcccagcaccagaca

SEQ ID NO: 8438 - DNA, 18 bp, Artificial sequence
  synthetic sequence
cagccaaagccaaggcca

SEQ ID NO: 8439 - DNA, 20 bp, Artificial sequence
  synthetic sequence
aaggagaagcggcgcctgga

SEQ ID NO: 8440 - DNA, 21 bp, Artificial sequence
  synthetic sequence
aggcaacgaagctgggaagga

SEQ ID NO: 8441 - DNA, 19 bp, Artificial sequence
  synthetic sequence
tcatacgagaaggcgacga

SEQ ID NO: 8442 - DNA, 20 bp, Artificial sequence
  synthetic sequence
cgggctcagacactctgcaa

SEQ ID NO: 8443 - DNA, 18 bp, Artificial sequence
  synthetic sequence
acagctgcatgaacccca

SEQ ID NO: 8444 - DNA, 18 bp, Artificial sequence
  synthetic sequence
ggcgcatgctgagaagca

SEQ ID NO: 8445 - DNA, 21 bp, Artificial sequence
  synthetic sequence
ggtcaccgatccctacaacga

SEQ ID NO: 8446 - DNA, 20 bp, Artificial sequence
  synthetic sequence
cctgagaacaccgacctgca

SEQ ID NO: 8447 - DNA, 20 bp, Artificial sequence
  synthetic sequence
cactcggcagcagtaccaga

SEQ ID NO: 8448 - DNA, 20 bp, Artificial sequence
  synthetic sequence
tacgctcagtgaccaggtca

SEQ ID NO: 8449 - DNA, 18 bp, Artificial sequence
  synthetic sequence
agaccacgaccagcacca

SEQ ID NO: 8450 - DNA, 18 bp, Artificial sequence
  synthetic sequence
ccgcgtggtagcaaccaa

SEQ ID NO: 8451 - DNA, 20 bp, Artificial sequence
  synthetic sequence
ggagacagggcacctctaca

SEQ ID NO: 8452 - DNA, 17 bp, Artificial sequence
  synthetic sequence
tgagccggccagtgcca

SEQ ID NO: 8453 - DNA, 20 bp, Artificial sequence
  synthetic sequence
cgcctggagctctacagcca

SEQ ID NO: 8454 - DNA, 18 bp, Artificial sequence
  synthetic sequence
atggagaggctggcccaa

SEQ ID NO: 8455 - DNA, 18 bp, Artificial sequence
  synthetic sequence
gcaggccaagatggacca

SEQ ID NO: 8456 - DNA, 20 bp, Artificial sequence
  synthetic sequence
cagaagcccctacagagcca

SEQ ID NO: 8457 - DNA, 18 bp, Artificial sequence
  synthetic sequence
ccaggcgttggaacccaa

SEQ ID NO: 8458 - DNA, 18 bp, Artificial sequence
  synthetic sequence
ctggcaaagaaggcggca

SEQ ID NO: 8459 - DNA, 19 bp, Artificial sequence
  synthetic sequence
gaggtcctagtggcccaca

SEQ ID NO: 8460 - DNA, 20 bp, Artificial sequence
  synthetic sequence
ggtccagcgcgtgtaccaga

SEQ ID NO: 8461 - DNA, 18 bp, Artificial sequence
  synthetic sequence
ggacgaagcagctggcaa

SEQ ID NO: 8462 - DNA, 20 bp, Artificial sequence
  synthetic sequence
cagggcctcgaggtaacaga

SEQ ID NO: 8463 - DNA, 19 bp, Artificial sequence
  synthetic sequence
cggccctactggtgaacca

SEQ ID NO: 8464 - DNA, 20 bp, Artificial sequence
  synthetic sequence
ctgggcaacgtggagagaga

SEQ ID NO: 8465 - DNA, 18 bp, Artificial sequence
  synthetic sequence
agggggaaaagggccaca

SEQ ID NO: 8466 - DNA, 18 bp, Artificial sequence
  synthetic sequence
ccaggtgaatgagcccca

SEQ ID NO: 8467 - DNA, 20 bp, Artificial sequence
  synthetic sequence
gtggtgcagtacagccacga

SEQ ID NO: 8468 - DNA, 18 bp, Artificial sequence
  synthetic sequence
acagcgctgagaccacca

SEQ ID NO: 8469 - DNA, 21 bp, Artificial sequence
  synthetic sequence
gaagaagcagctcctccagca

SEQ ID NO: 8470 - DNA, 18 bp, Artificial sequence
  synthetic sequence
gaatgcccagtgcaccca

SEQ ID NO: 8471 - DNA, 18 bp, Artificial sequence
  synthetic sequence
tcgaggcgagaagggaga

SEQ ID NO: 8472 - DNA, 18 bp, Artificial sequence
  synthetic sequence
tgatgcctgcgacgacga

SEQ ID NO: 8473 - DNA, 18 bp, Artificial sequence
  synthetic sequence
cgccggaaatgaggccga

SEQ ID NO: 8474 - DNA, 18 bp, Artificial sequence
  synthetic sequence
ggacctacagccagggca

SEQ ID NO: 8475 - DNA, 18 bp, Artificial sequence
  synthetic sequence
cctgggcagcatgaagga

SEQ ID NO: 8476 - DNA, 20 bp, Artificial sequence
  synthetic sequence
gaagccgtcaaaaagcctga

SEQ ID NO: 8477 - DNA, 18 bp, Artificial sequence
  synthetic sequence
cagggccatcatggagga

SEQ ID NO: 8478 - DNA, 18 bp, Artificial sequence
  synthetic sequence
acagcttcacgggaggca

SEQ ID NO: 8479 - DNA, 18 bp, Artificial sequence
  synthetic sequence
atgtgacccccacccaga

SEQ ID NO: 8480 - DNA, 19 bp, Artificial sequence
  synthetic sequence
ccctgggccagaaagagga

SEQ ID NO: 8481 - DNA, 21 bp, Artificial sequence
  synthetic sequence
catgggactgggaagtcagca

SEQ ID NO: 8482 - DNA, 18 bp, Artificial sequence
  synthetic sequence
caccatctccacgctgga

SEQ ID NO: 8483 - DNA, 20 bp, Artificial sequence
  synthetic sequence
atctgcacagcctgtgacga

SEQ ID NO: 8484 - DNA, 20 bp, Artificial sequence
  synthetic sequence
cagaacccctcacgcaccca

SEQ ID NO: 8485 - DNA, 20 bp, Artificial sequence
  synthetic sequence
ccgctaccgagtggaggaca

SEQ ID NO: 8486 - DNA, 21 bp, Artificial sequence
  synthetic sequence
caccaacgcctcccaaaccaa

SEQ ID NO: 8487 - DNA, 21 bp, Artificial sequence
  synthetic sequence
gtgcctaacgtaaccctgcaa

SEQ ID NO: 8488 - DNA, 18 bp, Artificial sequence
  synthetic sequence
gcgagggttccagggaga

SEQ ID NO: 8489 - DNA, 18 bp, Artificial sequence
  synthetic sequence
ggagcaccagggatcgga

SEQ ID NO: 8490 - DNA, 20 bp, Artificial sequence
  synthetic sequence
gaaacccaggaggctggaga

SEQ ID NO: 8491 - DNA, 19 bp, Artificial sequence
  synthetic sequence
gagccgacctgcctacaga

SEQ ID NO: 8492 - DNA, 20 bp, Artificial sequence
  synthetic sequence
gagctcctggagtgaagcca

SEQ ID NO: 8493 - DNA, 18 bp, Artificial sequence
  synthetic sequence
tccagaacgcccacagca

SEQ ID NO: 8494 - DNA, 18 bp, Artificial sequence
  synthetic sequence
cacgccacccatcaccaa

SEQ ID NO: 8495 - DNA, 20 bp, Artificial sequence
  synthetic sequence
agtacgaggtccagcgggca

SEQ ID NO: 8496 - DNA, 21 bp, Artificial sequence
  synthetic sequence
ctgcgagtccatcatcaccga

SEQ ID NO: 8497 - DNA, 20 bp, Artificial sequence
  synthetic sequence
gctgaacctggctaccagga

SEQ ID NO: 8498 - DNA, 20 bp, Artificial sequence
  synthetic sequence
gtgaggccattgtggacaca

SEQ ID NO: 8499 - DNA, 18 bp, Artificial sequence
  synthetic sequence
gcaggggagatcatcgga

SEQ ID NO: 8500 - DNA, 18 bp, Artificial sequence
  synthetic sequence
aacccaacaggcaaggca

SEQ ID NO: 8501 - DNA, 20 bp, Artificial sequence
  synthetic sequence
caactccatgaacaaccgga

SEQ ID NO: 8502 - DNA, 19 bp, Artificial sequence
  synthetic sequence
ccaaagagccgtacgtcca

SEQ ID NO: 8503 - DNA, 20 bp, Artificial sequence
  synthetic sequence
ggaccctcaagctgaatgga

SEQ ID NO: 8504 - DNA, 19 bp, Artificial sequence
  synthetic sequence
ggacccatgggttcaggaa

SEQ ID NO: 8505 - DNA, 18 bp, Artificial sequence
  synthetic sequence
agccagggcccatcgcca

SEQ ID NO: 8506 - DNA, 20 bp, Artificial sequence
  synthetic sequence
gctcaccagtccctccccaa

SEQ ID NO: 8507 - DNA, 20 bp, Artificial sequence
  synthetic sequence
atctacgccttcattggcca

SEQ ID NO: 8508 - DNA, 20 bp, Artificial sequence
  synthetic sequence
cagctctgaggactgcacca

SEQ ID NO: 8509 - DNA, 20 bp, Artificial sequence
  synthetic sequence
gccaacgtcagtgaggcaga

SEQ ID NO: 8510 - DNA, 20 bp, Artificial sequence
  synthetic sequence
gagaaccaagcagaaacgca

SEQ ID NO: 8511 - DNA, 21 bp, Artificial sequence
  synthetic sequence
cagaggccatcgcatacctga

SEQ ID NO: 8512 - DNA, 17 bp, Artificial sequence
  synthetic sequence
ggacggcccaactggga

SEQ ID NO: 8513 - DNA, 19 bp, Artificial sequence
  synthetic sequence
ccccgaagtccagacagca

SEQ ID NO: 8514 - DNA, 18 bp, Artificial sequence
  synthetic sequence
ctgccacatgccatgaca

SEQ ID NO: 8515 - DNA, 20 bp, Artificial sequence
  synthetic sequence
gcctgcaagaccgaggctga

SEQ ID NO: 8516 - DNA, 19 bp, Artificial sequence
  synthetic sequence
ggctgctccctgaaccaga

SEQ ID NO: 8517 - DNA, 18 bp, Artificial sequence
  synthetic sequence
gcctatgtggggaagcca

SEQ ID NO: 8518 - DNA, 20 bp, Artificial sequence
  synthetic sequence
gttccctgtcagacaagcga

SEQ ID NO: 8519 - DNA, 18 bp, Artificial sequence
  synthetic sequence
atgtcagggcaccccaca

SEQ ID NO: 8520 - DNA, 18 bp, Artificial sequence
  synthetic sequence
gtccatgcaggaggcaca

SEQ ID NO: 8521 - DNA, 18 bp, Artificial sequence
  synthetic sequence
tctggccaacacgcctca

SEQ ID NO: 8522 - DNA, 21 bp, Artificial sequence
  synthetic sequence
aaactccaggttggcccacaa

SEQ ID NO: 8523 - DNA, 19 bp, Artificial sequence
  synthetic sequence
gccagctctctacccccaa

SEQ ID NO: 8524 - DNA, 18 bp, Artificial sequence
  synthetic sequence
cgagatctggccacacga

SEQ ID NO: 8525 - DNA, 18 bp, Artificial sequence
  synthetic sequence
cacctgccatggagggga

SEQ ID NO: 8526 - DNA, 18 bp, Artificial sequence
  synthetic sequence
gatggagccttggaccga

SEQ ID NO: 8527 - DNA, 18 bp, Artificial sequence
  synthetic sequence
gctgcacggatctcgaga

SEQ ID NO: 8528 - DNA, 20 bp, Artificial sequence
  synthetic sequence
gaggtgcggacatccatcga

SEQ ID NO: 8529 - DNA, 20 bp, Artificial sequence
  synthetic sequence
tcggggggtaggaaaggaca

SEQ ID NO: 8530 - DNA, 18 bp, Artificial sequence
  synthetic sequence
caccaacatgccacggca

SEQ ID NO: 8531 - DNA, 18 bp, Artificial sequence
  synthetic sequence
cccaagcgcctcaagaca

SEQ ID NO: 8532 - DNA, 20 bp, Artificial sequence
  synthetic sequence
ctcaggttgcctagcaggaa

SEQ ID NO: 8533 - DNA, 18 bp, Artificial sequence
  synthetic sequence
agggaagcaccctggaca

SEQ ID NO: 8534 - DNA, 18 bp, Artificial sequence
  synthetic sequence
cctgcaccaacaaggcca

SEQ ID NO: 8535 - DNA, 19 bp, Artificial sequence
  synthetic sequence
ttgcagtggctcaggagga

SEQ ID NO: 8536 - DNA, 18 bp, Artificial sequence
  synthetic sequence
cctgaccttcgccagcaa

SEQ ID NO: 8537 - DNA, 20 bp, Artificial sequence
  synthetic sequence
agggagaacatgtacgggga

SEQ ID NO: 8538 - DNA, 18 bp, Artificial sequence
  synthetic sequence
ctgcagggaagcacagca

SEQ ID NO: 8539 - DNA, 19 bp, Artificial sequence
  synthetic sequence
gaccaagacatggccacca

SEQ ID NO: 8540 - DNA, 19 bp, Artificial sequence
  synthetic sequence
ggcgctaagaccggacaga

SEQ ID NO: 8541 - DNA, 19 bp, Artificial sequence
  synthetic sequence
cctgctccaaactccacca

SEQ ID NO: 8542 - DNA, 18 bp, Artificial sequence
  synthetic sequence
cacacgctcctcacccaa

SEQ ID NO: 8543 - DNA, 22 bp, Artificial sequence
  synthetic sequence
aagcagcgtcgagaagtggcaa

SEQ ID NO: 8544 - DNA, 18 bp, Artificial sequence
  synthetic sequence
tcagaagcgaggggagca

SEQ ID NO: 8545 - DNA, 18 bp, Artificial sequence
  synthetic sequence
tcacagtcctcaggccca

SEQ ID NO: 8546 - DNA, 18 bp, Artificial sequence
  synthetic sequence
gcccatcccccaggagga

SEQ ID NO: 8547 - DNA, 18 bp, Artificial sequence
  synthetic sequence
catgagtcagccgagcca

SEQ ID NO: 8548 - DNA, 18 bp, Artificial sequence
  synthetic sequence
ccaggagttcagccccaa

SEQ ID NO: 8549 - DNA, 19 bp, Artificial sequence
  synthetic sequence
ccgctaaggactgcggaca

SEQ ID NO: 8550 - DNA, 20 bp, Artificial sequence
  synthetic sequence
ctgggaaggagaacctgcca

SEQ ID NO: 8551 - DNA, 18 bp, Artificial sequence
  synthetic sequence
ggggtgcaggagaggaga

SEQ ID NO: 8552 - DNA, 19 bp, Artificial sequence
  synthetic sequence
gctactcctccagccccga

SEQ ID NO: 8553 - DNA, 20 bp, Artificial sequence
  synthetic sequence
caggagccgccagtccccaa

SEQ ID NO: 8554 - DNA, 21 bp, Artificial sequence
  synthetic sequence
agaagcactcagatgagggga

SEQ ID NO: 8555 - DNA, 20 bp, Artificial sequence
  synthetic sequence
cgccccgagatcccaacaga

SEQ ID NO: 8556 - DNA, 18 bp, Artificial sequence
  synthetic sequence
acggtccccttcgacaga

SEQ ID NO: 8557 - DNA, 18 bp, Artificial sequence
  synthetic sequence
gcagaggttgcagagcca

SEQ ID NO: 8558 - DNA, 19 bp, Artificial sequence
  synthetic sequence
ccgggtctcaagaccagga

SEQ ID NO: 8559 - DNA, 21 bp, Artificial sequence
  synthetic sequence
caacccaaagaggatcgccaa

SEQ ID NO: 8560 - DNA, 20 bp, Artificial sequence
  synthetic sequence
caccggctcctaataacgga

SEQ ID NO: 8561 - DNA, 21 bp, Artificial sequence
  synthetic sequence
tgagccatcccatgcagagga

SEQ ID NO: 8562 - DNA, 19 bp, Artificial sequence
  synthetic sequence
ttgagcccagttgctgcaa

SEQ ID NO: 8563 - DNA, 18 bp, Artificial sequence
  synthetic sequence
caagatccagggcagcga

SEQ ID NO: 8564 - DNA, 22 bp, Artificial sequence
  synthetic sequence
gaatggctcaaaacttgggaga

SEQ ID NO: 8565 - DNA, 18 bp, Artificial sequence
  synthetic sequence
tgaccaagccaccaagca

SEQ ID NO: 8566 - DNA, 18 bp, Artificial sequence
  synthetic sequence
actgcttgccaaccccca

SEQ ID NO: 8567 - DNA, 18 bp, Artificial sequence
  synthetic sequence
ctgtgcagtggatggcga

SEQ ID NO: 8568 - DNA, 18 bp, Artificial sequence
  synthetic sequence
gtgagccatgcagcccaa

SEQ ID NO: 8569 - DNA, 18 bp, Artificial sequence
  synthetic sequence
tcggacagctgccaggaa

SEQ ID NO: 8570 - DNA, 19 bp, Artificial sequence
  synthetic sequence
tcgagcacgtacagcagca

SEQ ID NO: 8571 - DNA, 23 bp, Artificial sequence
  synthetic sequence
caaaatggtccagtacagggaca

SEQ ID NO: 8572 - DNA, 18 bp, Artificial sequence
  synthetic sequence
catgggccagttcgacca

SEQ ID NO: 8573 - DNA, 20 bp, Artificial sequence
  synthetic sequence
ctgaaggtgggctacaccga

SEQ ID NO: 8574 - DNA, 18 bp, Artificial sequence
  synthetic sequence
gcggctaaacgacggaca

SEQ ID NO: 8575 - DNA, 20 bp, Artificial sequence
  synthetic sequence
tggcacagtctacaagggca

SEQ ID NO: 8576 - DNA, 20 bp, Artificial sequence
  synthetic sequence
atgaaccggaggagaaggca

SEQ ID NO: 8577 - DNA, 21 bp, Artificial sequence
  synthetic sequence
tggcccaagagctcagacaca

SEQ ID NO: 8578 - DNA, 22 bp, Artificial sequence
  synthetic sequence
atgcccacggacatggaacaca

SEQ ID NO: 8579 - DNA, 18 bp, Artificial sequence
  synthetic sequence
ggaaacgtccagcaccga

SEQ ID NO: 8580 - DNA, 20 bp, Artificial sequence
  synthetic sequence
acactcatcagcaccccaga

SEQ ID NO: 8581 - DNA, 21 bp, Artificial sequence
  synthetic sequence
acacgggaagacactgggaca

SEQ ID NO: 8582 - DNA, 18 bp, Artificial sequence
  synthetic sequence
tccaccgtgcagtgggaa

SEQ ID NO: 8583 - DNA, 18 bp, Artificial sequence
  synthetic sequence
cggatgcagagatcggca

SEQ ID NO: 8584 - DNA, 18 bp, Artificial sequence
  synthetic sequence
gcacctggccacggcaga

SEQ ID NO: 8585 - DNA, 25 bp, Artificial sequence
  synthetic sequence
gacggacacaaactaagggatgcca

SEQ ID NO: 8586 - DNA, 20 bp, Artificial sequence
  synthetic sequence
gagtgtgacctcaccgacga

SEQ ID NO: 8587 - DNA, 18 bp, Artificial sequence
  synthetic sequence
gcagggatgcaaacgcca

SEQ ID NO: 8588 - DNA, 18 bp, Artificial sequence
  synthetic sequence
tgggctttgccaccagga

SEQ ID NO: 8589 - DNA, 21 bp, Artificial sequence
  synthetic sequence
ctggaagctgaccaacagtca

SEQ ID NO: 8590 - DNA, 18 bp, Artificial sequence
  synthetic sequence
cccagcttccctgaacga

SEQ ID NO: 8591 - DNA, 18 bp, Artificial sequence
  synthetic sequence
gaggcaacagcaccgcaa

SEQ ID NO: 8592 - DNA, 18 bp, Artificial sequence
  synthetic sequence
ggagggaaggccggggaa

SEQ ID NO: 8593 - DNA, 18 bp, Artificial sequence
  synthetic sequence
ccctcaaggcagccgtga

SEQ ID NO: 8594 - DNA, 18 bp, Artificial sequence
  synthetic sequence
gtggcaagtgggaggcca

SEQ ID NO: 8595 - DNA, 21 bp, Artificial sequence
  synthetic sequence
tcagaacttggaaggcctgca

SEQ ID NO: 8596 - DNA, 19 bp, Artificial sequence
  synthetic sequence
gcctccactaccgctgcca

SEQ ID NO: 8597 - DNA, 18 bp, Artificial sequence
  synthetic sequence
gaattccaccgaggccga

SEQ ID NO: 8598 - DNA, 18 bp, Artificial sequence
  synthetic sequence
ggagatgcacagcagcga

SEQ ID NO: 8599 - DNA, 19 bp, Artificial sequence
  synthetic sequence
ggcactctggtaggcacca

SEQ ID NO: 8600 - DNA, 18 bp, Artificial sequence
  synthetic sequence
gctacaccatgacggcca

SEQ ID NO: 8601 - DNA, 18 bp, Artificial sequence
  synthetic sequence
taaccaccgctgccagca

SEQ ID NO: 8602 - DNA, 21 bp, Artificial sequence
  synthetic sequence
tgagctgtgccccaaagacga

SEQ ID NO: 8603 - DNA, 18 bp, Artificial sequence
  synthetic sequence
cgcatggccgtggcagga

SEQ ID NO: 8604 - DNA, 18 bp, Artificial sequence
  synthetic sequence
ggtggtgatggagggcca

SEQ ID NO: 8605 - DNA, 18 bp, Artificial sequence
  synthetic sequence
tgacgacatggaagggca

SEQ ID NO: 8606 - DNA, 18 bp, Artificial sequence
  synthetic sequence
ctgcgaggcaggaacaca

SEQ ID NO: 8607 - DNA, 20 bp, Artificial sequence
  synthetic sequence
ctcatccaagcctgtgacca

SEQ ID NO: 8608 - DNA, 20 bp, Artificial sequence
  synthetic sequence
ctcatccaagcctgtgacca

SEQ ID NO: 8609 - DNA, 20 bp, Artificial sequence
  synthetic sequence
agcatcagccccaatgccca

SEQ ID NO: 8610 - DNA, 18 bp, Artificial sequence
  synthetic sequence
agctggcatgcggactga

SEQ ID NO: 8611 - DNA, 21 bp, Artificial sequence
  synthetic sequence
cccggtgcagctagaagtcca

SEQ ID NO: 8612 - DNA, 18 bp, Artificial sequence
  synthetic sequence
ggccccaacagtgacgga

SEQ ID NO: 8613 - DNA, 20 bp, Artificial sequence
  synthetic sequence
gaggacaggtgatggaggga

SEQ ID NO: 8614 - DNA, 21 bp, Artificial sequence
  synthetic sequence
ctactcctgtgaggccaacaa

SEQ ID NO: 8615 - DNA, 21 bp, Artificial sequence
  synthetic sequence
ccagatctggagcatccagca

SEQ ID NO: 8616 - DNA, 19 bp, Artificial sequence
  synthetic sequence
gcagtggcctctgacccca

SEQ ID NO: 8617 - DNA, 20 bp, Artificial sequence
  synthetic sequence
caggtggagagcagtgccca

SEQ ID NO: 8618 - DNA, 20 bp, Artificial sequence
  synthetic sequence
aagcagaaggagcagcgaga

SEQ ID NO: 8619 - DNA, 19 bp, Artificial sequence
  synthetic sequence
gggggctcctatgacccaa

SEQ ID NO: 8620 - DNA, 18 bp, Artificial sequence
  synthetic sequence
gctcgtccagccaaagca

SEQ ID NO: 8621 - DNA, 18 bp, Artificial sequence
  synthetic sequence
cctgggctcacggggaga

SEQ ID NO: 8622 - DNA, 19 bp, Artificial sequence
  synthetic sequence
ctggaccagtactccccca

SEQ ID NO: 8623 - DNA, 19 bp, Artificial sequence
  synthetic sequence
tcaacggcagacaccccca

SEQ ID NO: 8624 - DNA, 18 bp, Artificial sequence
  synthetic sequence
cgccaactgcacacacga

SEQ ID NO: 8625 - DNA, 20 bp, Artificial sequence
  synthetic sequence
gaccgggtgtacacacacca

SEQ ID NO: 8626 - DNA, 18 bp, Artificial sequence
  synthetic sequence
gccttggcgccaacacca

SEQ ID NO: 8627 - DNA, 24 bp, Artificial sequence
  synthetic sequence
taactataatggcacagctggaga

SEQ ID NO: 8628 - DNA, 20 bp, Artificial sequence
  synthetic sequence
gaccaccggcaggatgtgga

SEQ ID NO: 8629 - DNA, 20 bp, Artificial sequence
  synthetic sequence
tacaaccggggcagcaggaa

SEQ ID NO: 8630 - DNA, 19 bp, Artificial sequence
  synthetic sequence
tcctgactgggatggcaga

SEQ ID NO: 8631 - DNA, 19 bp, Artificial sequence
  synthetic sequence
tctggcacccctgtaacca

SEQ ID NO: 8632 - DNA, 18 bp, Artificial sequence
  synthetic sequence
tcgcagaagcatcggcaa

SEQ ID NO: 8633 - DNA, 18 bp, Artificial sequence
  synthetic sequence
gctcgggactcagtggga

SEQ ID NO: 8634 - DNA, 18 bp, Artificial sequence
  synthetic sequence
caacaaggtgggccagga

SEQ ID NO: 8635 - DNA, 22 bp, Artificial sequence
  synthetic sequence
gaggaaatagccctgtccagga

SEQ ID NO: 8636 - DNA, 21 bp, Artificial sequence
  synthetic sequence
tccacgtgcaggccatctcca

SEQ ID NO: 8637 - DNA, 18 bp, Artificial sequence
  synthetic sequence
atgctccaagcagccaca

SEQ ID NO: 8638 - DNA, 20 bp, Artificial sequence
  synthetic sequence
cagcaactacagccgaggga

SEQ ID NO: 8639 - DNA, 18 bp, Artificial sequence
  synthetic sequence
cctgaaaggggaccccca

SEQ ID NO: 8640 - DNA, 18 bp, Artificial sequence
  synthetic sequence
gttcagggggcggcagca

SEQ ID NO: 8641 - DNA, 18 bp, Artificial sequence
  synthetic sequence
ctcgctgggcaacaacca

SEQ ID NO: 8642 - DNA, 18 bp, Artificial sequence
  synthetic sequence
ctacgccaccaatccgca

SEQ ID NO: 8643 - DNA, 20 bp, Artificial sequence
  synthetic sequence
catcctgccacctggaagaa

SEQ ID NO: 8644 - DNA, 21 bp, Artificial sequence
  synthetic sequence
tgccaccaagatccacaagca

SEQ ID NO: 8645 - DNA, 21 bp, Artificial sequence
  synthetic sequence
gcaccgtctggctcaaagaga

SEQ ID NO: 8646 - DNA, 21 bp, Artificial sequence
  synthetic sequence
agacacttcagtccccggcaa

SEQ ID NO: 8647 - DNA, 21 bp, Artificial sequence
  synthetic sequence
tggaccgcaccaagaggcaga

SEQ ID NO: 8648 - DNA, 20 bp, Artificial sequence
  synthetic sequence
atccagtggctggaagctga

SEQ ID NO: 8649 - DNA, 20 bp, Artificial sequence
  synthetic sequence
gaagggtgtggtgggcgaca

SEQ ID NO: 8650 - DNA, 18 bp, Artificial sequence
  synthetic sequence
gaactcgcagcacctgga

SEQ ID NO: 8651 - DNA, 21 bp, Artificial sequence
  synthetic sequence
accccgactacatcaccgaga

SEQ ID NO: 8652 - DNA, 18 bp, Artificial sequence
  synthetic sequence
tccccgcagtgaaaacca

SEQ ID NO: 8653 - DNA, 18 bp, Artificial sequence
  synthetic sequence
acccccatcccaagtcga

SEQ ID NO: 8654 - DNA, 21 bp, Artificial sequence
  synthetic sequence
gccaatcaatcggaaaggaga

SEQ ID NO: 8655 - DNA, 18 bp, Artificial sequence
  synthetic sequence
tcgggagaccttgcccaa

SEQ ID NO: 8656 - DNA, 18 bp, Artificial sequence
  synthetic sequence
gctctctgaccaccccga

SEQ ID NO: 8657 - DNA, 22 bp, Artificial sequence
  synthetic sequence
gtgacgtggaatccacacaaga

SEQ ID NO: 8658 - DNA, 18 bp, Artificial sequence
  synthetic sequence
tgagccctcccacatgca

SEQ ID NO: 8659 - DNA, 20 bp, Artificial sequence
  synthetic sequence
atgccaccacctaaaaggca

SEQ ID NO: 8660 - DNA, 18 bp, Artificial sequence
  synthetic sequence
ctgggaggcacaggagca

SEQ ID NO: 8661 - DNA, 20 bp, Artificial sequence
  synthetic sequence
ctcactggaggacttcccca

SEQ ID NO: 8662 - DNA, 20 bp, Artificial sequence
  synthetic sequence
cggcggcggtaacttcgaca

SEQ ID NO: 8663 - DNA, 19 bp, Artificial sequence
  synthetic sequence
ggactccaggcgtgcccaa

SEQ ID NO: 8664 - DNA, 18 bp, Artificial sequence
  synthetic sequence
ccgtcgcagtcggaccaa

SEQ ID NO: 8665 - DNA, 18 bp, Artificial sequence
  synthetic sequence
agccatccctgtccccaa

SEQ ID NO: 8666 - DNA, 18 bp, Artificial sequence
  synthetic sequence
tcgggaactccaggagca

SEQ ID NO: 8667 - DNA, 18 bp, Artificial sequence
  synthetic sequence
gcacagtcatgaccccca

SEQ ID NO: 8668 - DNA, 21 bp, Artificial sequence
  synthetic sequence
gcttcacagagctcacgacaa

SEQ ID NO: 8669 - DNA, 20 bp, Artificial sequence
  synthetic sequence
tgagccctgaacaccagaga

SEQ ID NO: 8670 - DNA, 18 bp, Artificial sequence
  synthetic sequence
gcaggaagccaaggagca

SEQ ID NO: 8671 - DNA, 21 bp, Artificial sequence
  synthetic sequence
ggaggtagccacattgggcca

SEQ ID NO: 8672 - DNA, 18 bp, Artificial sequence
  synthetic sequence
cggagaaactgcccagca

SEQ ID NO: 8673 - DNA, 18 bp, Artificial sequence
  synthetic sequence
cgagtgggagatcgccaa

SEQ ID NO: 8674 - DNA, 19 bp, Artificial sequence
  synthetic sequence
gtggggtgctccaagggca

SEQ ID NO: 8675 - DNA, 20 bp, Artificial sequence
  synthetic sequence
acttagcccagcggcctgca

SEQ ID NO: 8676 - DNA, 18 bp, Artificial sequence
  synthetic sequence
ccagctgcagaccctcga

SEQ ID NO: 8677 - DNA, 18 bp, Artificial sequence
  synthetic sequence
cttcaggcacgctggaga

SEQ ID NO: 8678 - DNA, 18 bp, Artificial sequence
  synthetic sequence
caaccacagcagctggca

SEQ ID NO: 8679 - DNA, 19 bp, Artificial sequence
  synthetic sequence
caggcactcaatctgggca

SEQ ID NO: 8680 - DNA, 19 bp, Artificial sequence
  synthetic sequence
gggtgtgagacacacgcca

SEQ ID NO: 8681 - DNA, 22 bp, Artificial sequence
  synthetic sequence
taaaacaaccgcttgtggccga

SEQ ID NO: 8682 - DNA, 18 bp, Artificial sequence
  synthetic sequence
agggagcattcccacgga

SEQ ID NO: 8683 - DNA, 18 bp, Artificial sequence
  synthetic sequence
ccaccgaggagggcacga

SEQ ID NO: 8684 - DNA, 20 bp, Artificial sequence
  synthetic sequence
tgccgggtactactacgcca

SEQ ID NO: 8685 - DNA, 20 bp, Artificial sequence
  synthetic sequence
ccactcctcagaaccagtga

SEQ ID NO: 8686 - DNA, 22 bp, Artificial sequence
  synthetic sequence
atgaggaagagagtgaggccaa

SEQ ID NO: 8687 - DNA, 21 bp, Artificial sequence
  synthetic sequence
tgcggccaaacccaagcacga

SEQ ID NO: 8688 - DNA, 21 bp, Artificial sequence
  synthetic sequence
ctgcaaccggaaagtctacca

SEQ ID NO: 8689 - DNA, 19 bp, Artificial sequence
  synthetic sequence
tcacgggctggaagagaca

SEQ ID NO: 8690 - DNA, 18 bp, Artificial sequence
  synthetic sequence
gctgcaacagtcgcacca

SEQ ID NO: 8691 - DNA, 25 bp, Artificial sequence
  synthetic sequence
atgaggaacaaggcaaggctgtcaa

SEQ ID NO: 8692 - DNA, 19 bp, Artificial sequence
  synthetic sequence
gctgtgacctcaccagcca

SEQ ID NO: 8693 - DNA, 20 bp, Artificial sequence
  synthetic sequence
caaagccctgtccacacgca

SEQ ID NO: 8694 - DNA, 18 bp, Artificial sequence
  synthetic sequence
ctgccgagacaaccgaca

SEQ ID NO: 8695 - DNA, 18 bp, Artificial sequence
  synthetic sequence
aggcacagctcaggccaa

SEQ ID NO: 8696 - DNA, 22 bp, Artificial sequence
  synthetic sequence
aaacgggacacatatgcagcca

SEQ ID NO: 8697 - DNA, 21 bp, Artificial sequence
  synthetic sequence
gaggtggaagagactcgtgca

SEQ ID NO: 8698 - DNA, 22 bp, Artificial sequence
  synthetic sequence
gcaggaagatcgaaagtgcgaa

SEQ ID NO: 8699 - DNA, 20 bp, Artificial sequence
  synthetic sequence
gaggagatcatcgggggcca

SEQ ID NO: 8700 - DNA, 20 bp, Artificial sequence
  synthetic sequence
tcaggaaggtcaccggccga

SEQ ID NO: 8701 - DNA, 22 bp, Artificial sequence
  synthetic sequence
aagagaaccagacgcaggaaga

SEQ ID NO: 8702 - DNA, 18 bp, Artificial sequence
  synthetic sequence
ccaacgtacccgccgaca

SEQ ID NO: 8703 - DNA, 20 bp, Artificial sequence
  synthetic sequence
aacccacgtcacctatcgga

SEQ ID NO: 8704 - DNA, 19 bp, Artificial sequence
  synthetic sequence
ggcaacgtggtgctcagga

SEQ ID NO: 8705 - DNA, 21 bp, Artificial sequence
  synthetic sequence
tgcaagcggaagagtcccgaa

SEQ ID NO: 8706 - DNA, 18 bp, Artificial sequence
  synthetic sequence
ccccggagaccgaggaga

SEQ ID NO: 8707 - DNA, 19 bp, Artificial sequence
  synthetic sequence
tcaccatgatgccacccaa

SEQ ID NO: 8708 - DNA, 19 bp, Artificial sequence
  synthetic sequence
gggagggtgggtgcctcca

SEQ ID NO: 8709 - DNA, 21 bp, Artificial sequence
  synthetic sequence
ctggattggagagcagcagaa

SEQ ID NO: 8710 - DNA, 23 bp, Artificial sequence
  synthetic sequence
gaaaacaagtcagaggaccagca

SEQ ID NO: 8711 - DNA, 20 bp, Artificial sequence
  synthetic sequence
gaagccaggaggagcagaca

SEQ ID NO: 8712 - DNA, 20 bp, Artificial sequence
  synthetic sequence
ccccacccccatgtccacca

SEQ ID NO: 8713 - DNA, 18 bp, Artificial sequence
  synthetic sequence
aggctgcgtgcagcgaca

SEQ ID NO: 8714 - DNA, 20 bp, Artificial sequence
  synthetic sequence
gtgccttctggacaagagca

SEQ ID NO: 8715 - DNA, 19 bp, Artificial sequence
  synthetic sequence
ctgaatgggcaggaggaga

SEQ ID NO: 8716 - DNA, 20 bp, Artificial sequence
  synthetic sequence
ctgggaggcccaagagccaa

SEQ ID NO: 8717 - DNA, 20 bp, Artificial sequence
  synthetic sequence
gtggagcacaccagcctgga

SEQ ID NO: 8718 - DNA, 20 bp, Artificial sequence
  synthetic sequence
tatgactgcaaggtggagca

SEQ ID NO: 8719 - DNA, 25 bp, Artificial sequence
  synthetic sequence
aaggtgcatcaccatctacaggaga

SEQ ID NO: 8720 - DNA, 18 bp, Artificial sequence
  synthetic sequence
ccagcctccagagcccca

SEQ ID NO: 8721 - DNA, 20 bp, Artificial sequence
  synthetic sequence
gcggagcatcgaggactgga

SEQ ID NO: 8722 - DNA, 20 bp, Artificial sequence
  synthetic sequence
gagagagcccaacgtcctca

SEQ ID NO: 8723 - DNA, 21 bp, Artificial sequence
  synthetic sequence
acaagccctctcacagtggaa

SEQ ID NO: 8724 - DNA, 21 bp, Artificial sequence
  synthetic sequence
gtccacaggcctgattcagaa

SEQ ID NO: 8725 - DNA, 20 bp, Artificial sequence
  synthetic sequence
cgccagggacaccgcacaga

SEQ ID NO: 8726 - DNA, 20 bp, Artificial sequence
  synthetic sequence
gaccgagtggccctgaggaa

SEQ ID NO: 8727 - DNA, 19 bp, Artificial sequence
  synthetic sequence
gggggaccagactcccaga

SEQ ID NO: 8728 - DNA, 19 bp, Artificial sequence
  synthetic sequence
gctcggagccaccaagaga

SEQ ID NO: 8729 - DNA, 21 bp, Artificial sequence
  synthetic sequence
tctcccatcaaaggacgtgca

SEQ ID NO: 8730 - DNA, 19 bp, Artificial sequence
  synthetic sequence
gctgaccaagaccaatgca

SEQ ID NO: 8731 - DNA, 18 bp, Artificial sequence
  synthetic sequence
ccaagccacgtggacaga

SEQ ID NO: 8732 - DNA, 22 bp, Artificial sequence
  synthetic sequence
ctgaagcagagcaatggaagca

SEQ ID NO: 8733 - DNA, 20 bp, Artificial sequence
  synthetic sequence
gcagaagcgagtcccaggga

SEQ ID NO: 8734 - DNA, 18 bp, Artificial sequence
  synthetic sequence
cagtgccctggaacgcaa

SEQ ID NO: 8735 - DNA, 18 bp, Artificial sequence
  synthetic sequence
caccggaaaaggtggcaa

SEQ ID NO: 8736 - DNA, 18 bp, Artificial sequence
  synthetic sequence
cggggtacaccacaagca

SEQ ID NO: 8737 - DNA, 21 bp, Artificial sequence
  synthetic sequence
tgaatacgagggggagtacga

SEQ ID NO: 8738 - DNA, 18 bp, Artificial sequence
  synthetic sequence
caagaaccagacccggga

SEQ ID NO: 8739 - DNA, 20 bp, Artificial sequence
  synthetic sequence
cacaaacactcagccccgaa

SEQ ID NO: 8740 - DNA, 18 bp, Artificial sequence
  synthetic sequence
gtccagctcacgaggcaa

SEQ ID NO: 8741 - DNA, 20 bp, Artificial sequence
  synthetic sequence
tacctgcccaagtcaccaga

SEQ ID NO: 8742 - DNA, 22 bp, Artificial sequence
  synthetic sequence
aaggggggcaaatactctgcga

SEQ ID NO: 8743 - DNA, 18 bp, Artificial sequence
  synthetic sequence
agccgctaccggaaccga

SEQ ID NO: 8744 - DNA, 19 bp, Artificial sequence
  synthetic sequence
gaaaggcaacccccagcta

SEQ ID NO: 8745 - DNA, 18 bp, Artificial sequence
  synthetic sequence
catgcacgccaacgccca

SEQ ID NO: 8746 - DNA, 18 bp, Artificial sequence
  synthetic sequence
ccgcagccgcaggtggaa

SEQ ID NO: 8747 - DNA, 18 bp, Artificial sequence
  synthetic sequence
cccggagtccgaggagga

SEQ ID NO: 8748 - DNA, 21 bp, Artificial sequence
  synthetic sequence
ctgacttgaatgtccaacgca

SEQ ID NO: 8749 - DNA, 23 bp, Artificial sequence
  synthetic sequence
aaaatactcacgcagaaggaaga

SEQ ID NO: 8750 - DNA, 19 bp, Artificial sequence
  synthetic sequence
ctacccggacctccagcca

SEQ ID NO: 8751 - DNA, 18 bp, Artificial sequence
  synthetic sequence
ccaggaacaacggggaga

SEQ ID NO: 8752 - DNA, 18 bp, Artificial sequence
  synthetic sequence
ccgtggcatcgttgagga

SEQ ID NO: 8753 - DNA, 20 bp, Artificial sequence
  synthetic sequence
gacgacgggcagatgcacaa

SEQ ID NO: 8754 - DNA, 18 bp, Artificial sequence
  synthetic sequence
caagttccaccccctcca

SEQ ID NO: 8755 - DNA, 18 bp, Artificial sequence
  synthetic sequence
gactgctgagcagcggca

SEQ ID NO: 8756 - DNA, 20 bp, Artificial sequence
  synthetic sequence
gaggctcagagacagacgga

SEQ ID NO: 8757 - DNA, 20 bp, Artificial sequence
  synthetic sequence
ggttctcaaccgcaccagca

SEQ ID NO: 8758 - DNA, 18 bp, Artificial sequence
  synthetic sequence
ggtggagcgaccagagga

SEQ ID NO: 8759 - DNA, 20 bp, Artificial sequence
  synthetic sequence
cagctgcagtgacctgggaa

SEQ ID NO: 8760 - DNA, 20 bp, Artificial sequence
  synthetic sequence
aaagctggggaatggagtga

SEQ ID NO: 8761 - DNA, 18 bp, Artificial sequence
  synthetic sequence
aggccaaggccaccagga

SEQ ID NO: 8762 - DNA, 18 bp, Artificial sequence
  synthetic sequence
ctgctccaactggccaca

SEQ ID NO: 8763 - DNA, 18 bp, Artificial sequence
  synthetic sequence
cccgagggagccagctca

SEQ ID NO: 8764 - DNA, 20 bp, Artificial sequence
  synthetic sequence
aacaagggcattgaagcgaa

SEQ ID NO: 8765 - DNA, 21 bp, Artificial sequence
  synthetic sequence
gctgcatcaacgctgatggga

SEQ ID NO: 8766 - DNA, 18 bp, Artificial sequence
  synthetic sequence
tcgccctgggcctacaga

SEQ ID NO: 8767 - DNA, 19 bp, Artificial sequence
  synthetic sequence
ggccgtcagaagcaggaga

SEQ ID NO: 8768 - DNA, 18 bp, Artificial sequence
  synthetic sequence
gtggcaagagcgagggca

SEQ ID NO: 8769 - DNA, 19 bp, Artificial sequence
  synthetic sequence
ctccactgcgctaccggga

SEQ ID NO: 8770 - DNA, 18 bp, Artificial sequence
  synthetic sequence
ggctgatatcccaggcca

SEQ ID NO: 8771 - DNA, 19 bp, Artificial sequence
  synthetic sequence
cgttgcaggagacggagga

SEQ ID NO: 8772 - DNA, 18 bp, Artificial sequence
  synthetic sequence
ccccgcatcaacctgaca

SEQ ID NO: 8773 - DNA, 19 bp, Artificial sequence
  synthetic sequence
cgggaccttgaggagccaa

SEQ ID NO: 8774 - DNA, 21 bp, Artificial sequence
  synthetic sequence
ggacttcacggagcagtcaca

SEQ ID NO: 8775 - DNA, 18 bp, Artificial sequence
  synthetic sequence
ccggcctggatatggaca

SEQ ID NO: 8776 - DNA, 20 bp, Artificial sequence
  synthetic sequence
gctgagtggggtgaagggaa

SEQ ID NO: 8777 - DNA, 18 bp, Artificial sequence
  synthetic sequence
agaggtcccaaggcacca

SEQ ID NO: 8778 - DNA, 19 bp, Artificial sequence
  synthetic sequence
cacgggaagacaaggtgga

SEQ ID NO: 8779 - DNA, 21 bp, Artificial sequence
  synthetic sequence
gtcctgaagtgtaacacccca

SEQ ID NO: 8780 - DNA, 20 bp, Artificial sequence
  synthetic sequence
ccggactgactgggaccaca

SEQ ID NO: 8781 - DNA, 21 bp, Artificial sequence
  synthetic sequence
caacaggcgtcaacagtacga

SEQ ID NO: 8782 - DNA, 22 bp, Artificial sequence
  synthetic sequence
aggaggaggaggaggtagagga

SEQ ID NO: 8783 - DNA, 21 bp, Artificial sequence
  synthetic sequence
agcaaagacacactggggaga

SEQ ID NO: 8784 - DNA, 18 bp, Artificial sequence
  synthetic sequence
tccacccccatgcaggca

SEQ ID NO: 8785 - DNA, 18 bp, Artificial sequence
  synthetic sequence
gcgctgtggagacgcgga

SEQ ID NO: 8786 - DNA, 21 bp, Artificial sequence
  synthetic sequence
taatagctcaggggagatgga

SEQ ID NO: 8787 - DNA, 20 bp, Artificial sequence
  synthetic sequence
gaccaaggaggaggcgccaa

SEQ ID NO: 8788 - DNA, 18 bp, Artificial sequence
  synthetic sequence
gcaggtggggcaggtgga

SEQ ID NO: 8789 - DNA, 18 bp, Artificial sequence
  synthetic sequence
cggtcaacgagtcagcca

SEQ ID NO: 8790 - DNA, 18 bp, Artificial sequence
  synthetic sequence
gggtcacccctcagcaca

SEQ ID NO: 8791 - DNA, 23 bp, Artificial sequence
  synthetic sequence
cagcaaaagcgcaggaagagaga

SEQ ID NO: 8792 - DNA, 18 bp, Artificial sequence
  synthetic sequence
gacaacgaggtgcagcca

SEQ ID NO: 8793 - DNA, 21 bp, Artificial sequence
  synthetic sequence
ccaactcagccaatccgcaca

SEQ ID NO: 8794 - DNA, 20 bp, Artificial sequence
  synthetic sequence
caggtggggatggtaagaca

SEQ ID NO: 8795 - DNA, 21 bp, Artificial sequence
  synthetic sequence
cagaacctgactgaaccccca

SEQ ID NO: 8796 - DNA, 21 bp, Artificial sequence
  synthetic sequence
gcttgttccccatccacggga

SEQ ID NO: 8797 - DNA, 18 bp, Artificial sequence
  synthetic sequence
agagttgccccgagcaca

SEQ ID NO: 8798 - DNA, 18 bp, Artificial sequence
  synthetic sequence
gatggacgcagccaacga

SEQ ID NO: 8799 - DNA, 18 bp, Artificial sequence
  synthetic sequence
caggccatcatccccaca

SEQ ID NO: 8800 - DNA, 21 bp, Artificial sequence
  synthetic sequence
cggagccagcatactaccgaa

SEQ ID NO: 8801 - DNA, 20 bp, Artificial sequence
  synthetic sequence
gggactcaactgcaccacca

SEQ ID NO: 8802 - DNA, 18 bp, Artificial sequence
  synthetic sequence
ggctgccaaatgcaggca

SEQ ID NO: 8803 - DNA, 18 bp, Artificial sequence
  synthetic sequence
catgcagtctgagcggga

SEQ ID NO: 8804 - DNA, 22 bp, Artificial sequence
  synthetic sequence
caaagaggaggaggttggacca

SEQ ID NO: 8805 - DNA, 18 bp, Artificial sequence
  synthetic sequence
gatggctgacgtggccaa

SEQ ID NO: 8806 - DNA, 20 bp, Artificial sequence
  synthetic sequence
ctcatgcccacagagggaga

SEQ ID NO: 8807 - DNA, 18 bp, Artificial sequence
  synthetic sequence
tggcagaggtgtcccgaa

SEQ ID NO: 8808 - DNA, 20 bp, Artificial sequence
  synthetic sequence
ctcgagtacgtgccacacca

SEQ ID NO: 8809 - DNA, 18 bp, Artificial sequence
  synthetic sequence
gcaaggtgagcgggacca

SEQ ID NO: 8810 - DNA, 20 bp, Artificial sequence
  synthetic sequence
gagggacctgcctgtcagca

SEQ ID NO: 8811 - DNA, 22 bp, Artificial sequence
  synthetic sequence
accaaggtagaaagtcgggaca

SEQ ID NO: 8812 - DNA, 18 bp, Artificial sequence
  synthetic sequence
tgagcgctacaacggcca

SEQ ID NO: 8813 - DNA, 19 bp, Artificial sequence
  synthetic sequence
ggggagccctacatgacga

SEQ ID NO: 8814 - DNA, 19 bp, Artificial sequence
  synthetic sequence
cggaggaccagaagggcaa

SEQ ID NO: 8815 - DNA, 18 bp, Artificial sequence
  synthetic sequence
tggccagatctgcagcga

SEQ ID NO: 8816 - DNA, 18 bp, Artificial sequence
  synthetic sequence
atccctcctgcagcggaa

SEQ ID NO: 8817 - DNA, 18 bp, Artificial sequence
  synthetic sequence
atgcgagagacaccggga

SEQ ID NO: 8818 - DNA, 18 bp, Artificial sequence
  synthetic sequence
ttcagcagcagcccagca

SEQ ID NO: 8819 - DNA, 18 bp, Artificial sequence
  synthetic sequence
agaagccagaggccagca

SEQ ID NO: 8820 - DNA, 20 bp, Artificial sequence
  synthetic sequence
gtggactgcaaggacccaga

SEQ ID NO: 8821 - DNA, 19 bp, Artificial sequence
  synthetic sequence
cgcaaggtgcctgaggcca

SEQ ID NO: 8822 - DNA, 18 bp, Artificial sequence
  synthetic sequence
ggtgccaagtgccaggaa

SEQ ID NO: 8823 - DNA, 18 bp, Artificial sequence
  synthetic sequence
ctgcgaccagtacggcaa

SEQ ID NO: 8824 - DNA, 21 bp, Artificial sequence
  synthetic sequence
tgacaagaagtgatgcgggga

SEQ ID NO: 8825 - DNA, 20 bp, Artificial sequence
  synthetic sequence
caggtgtgaggagcaggaga

SEQ ID NO: 8826 - DNA, 18 bp, Artificial sequence
  synthetic sequence
gcccggaagagcctcgaa

SEQ ID NO: 8827 - DNA, 18 bp, Artificial sequence
  synthetic sequence
cgagctggccgaacgaca

SEQ ID NO: 8828 - DNA, 19 bp, Artificial sequence
  synthetic sequence
gagcccagtcagagaccca

SEQ ID NO: 8829 - DNA, 20 bp, Artificial sequence
  synthetic sequence
aagaggctgttacggcacca

SEQ ID NO: 8830 - DNA, 19 bp, Artificial sequence
  synthetic sequence
tcccagttccaacaagcca

SEQ ID NO: 8831 - DNA, 18 bp, Artificial sequence
  synthetic sequence
acccccgacacctgcaca

SEQ ID NO: 8832 - DNA, 21 bp, Artificial sequence
  synthetic sequence
caacggaacattccaggccga

SEQ ID NO: 8833 - DNA, 23 bp, Artificial sequence
  synthetic sequence
ctgcctgctggagagaaaacaca

SEQ ID NO: 8834 - DNA, 21 bp, Artificial sequence
  synthetic sequence
ccaaggttcaggcaggagaga

SEQ ID NO: 8835 - DNA, 23 bp, Artificial sequence
  synthetic sequence
ggaaagagcagccaaaatcccaa

SEQ ID NO: 8836 - DNA, 20 bp, Artificial sequence
  synthetic sequence
gtggatggcacctgaaagca

SEQ ID NO: 8837 - DNA, 23 bp, Artificial sequence
  synthetic sequence
caaaactgaagggatctgcagga

SEQ ID NO: 8838 - DNA, 18 bp, Artificial sequence
  synthetic sequence
cccacagactcaggccca

SEQ ID NO: 8839 - DNA, 22 bp, Artificial sequence
  synthetic sequence
aaacccaaagaggcagcaacga

SEQ ID NO: 8840 - DNA, 22 bp, Artificial sequence
  synthetic sequence
ggtttactgccacctccagaga

SEQ ID NO: 8841 - DNA, 21 bp, Artificial sequence
  synthetic sequence
cagcatttactccaggaccca

SEQ ID NO: 8842 - DNA, 22 bp, Artificial sequence
  synthetic sequence
aaagaaaaggagttctgcccaa

SEQ ID NO: 8843 - DNA, 21 bp, Artificial sequence
  synthetic sequence
caggaaatgagcctgctccaa

SEQ ID NO: 8844 - DNA, 20 bp, Artificial sequence
  synthetic sequence
gtctcgacacagctgggaga

SEQ ID NO: 8845 - DNA, 18 bp, Artificial sequence
  synthetic sequence
ccgtggggaagaggagca

SEQ ID NO: 8846 - DNA, 18 bp, Artificial sequence
  synthetic sequence
ctggagaatgtgccccga

SEQ ID NO: 8847 - DNA, 21 bp, Artificial sequence
  synthetic sequence
ggagcctcgtgactacagcaa

SEQ ID NO: 8848 - DNA, 20 bp, Artificial sequence
  synthetic sequence
aggccccccgtgtggacaca

SEQ ID NO: 8849 - DNA, 18 bp, Artificial sequence
  synthetic sequence
ggctcggaagaaccgaga

SEQ ID NO: 8850 - DNA, 21 bp, Artificial sequence
  synthetic sequence
aactccagtcccatctcagca

SEQ ID NO: 8851 - DNA, 18 bp, Artificial sequence
  synthetic sequence
gtcccagatgcagacgca

SEQ ID NO: 8852 - DNA, 21 bp, Artificial sequence
  synthetic sequence
ggctggagtctgggatgcaga

SEQ ID NO: 8853 - DNA, 18 bp, Artificial sequence
  synthetic sequence
ggagaggatgttccggca

SEQ ID NO: 8854 - DNA, 20 bp, Artificial sequence
  synthetic sequence
gtgcccaacgctctgggaga

SEQ ID NO: 8855 - DNA, 18 bp, Artificial sequence
  synthetic sequence
gccgtcggacaacagtca

SEQ ID NO: 8856 - DNA, 18 bp, Artificial sequence
  synthetic sequence
ccgcctggagagggagga

SEQ ID NO: 8857 - DNA, 20 bp, Artificial sequence
  synthetic sequence
cagtgacacctgtgacccca

SEQ ID NO: 8858 - DNA, 20 bp, Artificial sequence
  synthetic sequence
gtggagctcactgatgggca

SEQ ID NO: 8859 - DNA, 18 bp, Artificial sequence
  synthetic sequence
actcggtggcagtcacca

SEQ ID NO: 8860 - DNA, 19 bp, Artificial sequence
  synthetic sequence
cctggaccctgaggacaca

SEQ ID NO: 8861 - DNA, 18 bp, Artificial sequence
  synthetic sequence
acgcgcagagcaaccaca

SEQ ID NO: 8862 - DNA, 18 bp, Artificial sequence
  synthetic sequence
gccagtgcgacaaagcca

SEQ ID NO: 8863 - DNA, 18 bp, Artificial sequence
  synthetic sequence
tcacacagggggtgagca

SEQ ID NO: 8864 - DNA, 18 bp, Artificial sequence
  synthetic sequence
ccgacactgatgcagcca

SEQ ID NO: 8865 - DNA, 18 bp, Artificial sequence
  synthetic sequence
tcacgtgactggccagga

SEQ ID NO: 8866 - DNA, 20 bp, Artificial sequence
  synthetic sequence
cagagctggaagagagggca

SEQ ID NO: 8867 - DNA, 20 bp, Artificial sequence
  synthetic sequence
gagcacgtccgtgtcacgaa

SEQ ID NO: 8868 - DNA, 22 bp, Artificial sequence
  synthetic sequence
tgcagctgaacatcactcagga

SEQ ID NO: 8869 - DNA, 19 bp, Artificial sequence
  synthetic sequence
gcctccagttgtcagccca

SEQ ID NO: 8870 - DNA, 18 bp, Artificial sequence
  synthetic sequence
cagcacacaaccacccga

SEQ ID NO: 8871 - DNA, 18 bp, Artificial sequence
  synthetic sequence
aggagggaggcaggacca

SEQ ID NO: 8872 - DNA, 20 bp, Artificial sequence
  synthetic sequence
ctgtggacagagcaagcaca

SEQ ID NO: 8873 - DNA, 18 bp, Artificial sequence
  synthetic sequence
acctccccaccatccaga

SEQ ID NO: 8874 - DNA, 21 bp, Artificial sequence
  synthetic sequence
acatgctcacgggagtctcca

SEQ ID NO: 8875 - DNA, 20 bp, Artificial sequence
  synthetic sequence
gaagctggagggactgcaca

SEQ ID NO: 8876 - DNA, 18 bp, Artificial sequence
  synthetic sequence
caccctcagcccatcaca

SEQ ID NO: 8877 - DNA, 20 bp, Artificial sequence
  synthetic sequence
caccaagctcagcagaacca

SEQ ID NO: 8878 - DNA, 21 bp, Artificial sequence
  synthetic sequence
ccacggtgacctcaggagaga

SEQ ID NO: 8879 - DNA, 18 bp, Artificial sequence
  synthetic sequence
ctgtgacccccagccaca

SEQ ID NO: 8880 - DNA, 18 bp, Artificial sequence
  synthetic sequence
gacatcgacgtcagggca

SEQ ID NO: 8881 - DNA, 18 bp, Artificial sequence
  synthetic sequence
cctgaactcccagcccca

SEQ ID NO: 8882 - DNA, 21 bp, Artificial sequence
  synthetic sequence
ccagctgctgacgtccaggaa

SEQ ID NO: 8883 - DNA, 19 bp, Artificial sequence
  synthetic sequence
ctacagggtcagtccccca

SEQ ID NO: 8884 - DNA, 20 bp, Artificial sequence
  synthetic sequence
ctggtctacaccgaggagga

SEQ ID NO: 8885 - DNA, 18 bp, Artificial sequence
  synthetic sequence
acacgcccgacgaggaga

SEQ ID NO: 8886 - DNA, 18 bp, Artificial sequence
  synthetic sequence
cacagccattgtccgcaa

SEQ ID NO: 8887 - DNA, 20 bp, Artificial sequence
  synthetic sequence
gaactcagcctacacccgaa

SEQ ID NO: 8888 - DNA, 18 bp, Artificial sequence
  synthetic sequence
cggcatggtgggcgacga

SEQ ID NO: 8889 - DNA, 18 bp, Artificial sequence
  synthetic sequence
atggactggccctacgga

SEQ ID NO: 8890 - DNA, 20 bp, Artificial sequence
  synthetic sequence
cgaaaggtccgccgtcacca

SEQ ID NO: 8891 - DNA, 20 bp, Artificial sequence
  synthetic sequence
cagttcaccaccgctgggga

SEQ ID NO: 8892 - DNA, 21 bp, Artificial sequence
  synthetic sequence
agggcttccagcaccaacgga

SEQ ID NO: 8893 - DNA, 19 bp, Artificial sequence
  synthetic sequence
ctcactgcccctagagcca

SEQ ID NO: 8894 - DNA, 21 bp, Artificial sequence
  synthetic sequence
gcagcctactccacaggagga

SEQ ID NO: 8895 - DNA, 25 bp, Artificial sequence
  synthetic sequence
tcaaggacaagggcttagacaacca

SEQ ID NO: 8896 - DNA, 21 bp, Artificial sequence
  synthetic sequence
tggtcaggcacacagtgtgaa

SEQ ID NO: 8897 - DNA, 19 bp, Artificial sequence
  synthetic sequence
gggagtgcacagagagcga

SEQ ID NO: 8898 - DNA, 18 bp, Artificial sequence
  synthetic sequence
gtgccaacctcaacggca

SEQ ID NO: 8899 - DNA, 20 bp, Artificial sequence
  synthetic sequence
gaggaagtcagcctggagga

SEQ ID NO: 8900 - DNA, 20 bp, Artificial sequence
  synthetic sequence
gcctaggttagggacggaca

SEQ ID NO: 8901 - DNA, 21 bp, Artificial sequence
  synthetic sequence
atgtttgtgggccagccagca

SEQ ID NO: 8902 - DNA, 18 bp, Artificial sequence
  synthetic sequence
actcagctgctgcggcaa

SEQ ID NO: 8903 - DNA, 18 bp, Artificial sequence
  synthetic sequence
ccgagctcaaatgccgca

SEQ ID NO: 8904 - DNA, 21 bp, Artificial sequence
  synthetic sequence
agaatgtccaaggggcagaca

SEQ ID NO: 8905 - DNA, 20 bp, Artificial sequence
  synthetic sequence
ggtccgcagagccgaactga

SEQ ID NO: 8906 - DNA, 22 bp, Artificial sequence
  synthetic sequence
atgagtgcaaagctgccaacga

SEQ ID NO: 8907 - DNA, 19 bp, Artificial sequence
  synthetic sequence
gtatccagggctgcaggaa

SEQ ID NO: 8908 - DNA, 23 bp, Artificial sequence
  synthetic sequence
gccccaggaaacaaagattccca

SEQ ID NO: 8909 - DNA, 18 bp, Artificial sequence
  synthetic sequence
cggagccagaagtggcaa

SEQ ID NO: 8910 - DNA, 18 bp, Artificial sequence
  synthetic sequence
gtgaacgagtgcgaggca

SEQ ID NO: 8911 - DNA, 18 bp, Artificial sequence
  synthetic sequence
agccactgcccccagaga

SEQ ID NO: 8912 - DNA, 18 bp, Artificial sequence
  synthetic sequence
gcctcgatggcaaacgga

SEQ ID NO: 8913 - DNA, 20 bp, Artificial sequence
  synthetic sequence
gagtgcctaagacccccaca

SEQ ID NO: 8914 - DNA, 20 bp, Artificial sequence
  synthetic sequence
ctgccctgaaagctacccaa

SEQ ID NO: 8915 - DNA, 18 bp, Artificial sequence
  synthetic sequence
ctcccagcgaacggacga

SEQ ID NO: 8916 - DNA, 21 bp, Artificial sequence
  synthetic sequence
aaagcagacagacgttgcaga

SEQ ID NO: 8917 - DNA, 18 bp, Artificial sequence
  synthetic sequence
ctgaggtgcacaagccca

SEQ ID NO: 8918 - DNA, 18 bp, Artificial sequence
  synthetic sequence
ccaccaggaccgcagcaa

SEQ ID NO: 8919 - DNA, 18 bp, Artificial sequence
  synthetic sequence
aggcgaaccagcagctga

SEQ ID NO: 8920 - DNA, 21 bp, Artificial sequence
  synthetic sequence
tgctggaggactggactgcta

SEQ ID NO: 8921 - DNA, 20 bp, Artificial sequence
  synthetic sequence
tgccgcttcaagagggtgca

SEQ ID NO: 8922 - DNA, 20 bp, Artificial sequence
  synthetic sequence
ctcaggggccatcagtggga

SEQ ID NO: 8923 - DNA, 18 bp, Artificial sequence
  synthetic sequence
gaaaggccatcgagggga

SEQ ID NO: 8924 - DNA, 18 bp, Artificial sequence
  synthetic sequence
accccgacgactcagcaa

SEQ ID NO: 8925 - DNA, 19 bp, Artificial sequence
  synthetic sequence
ccctggacatcagggagca

SEQ ID NO: 8926 - DNA, 17 bp, Artificial sequence
  synthetic sequence
ccagcggaggcggcaga

SEQ ID NO: 8927 - DNA, 19 bp, Artificial sequence
  synthetic sequence
ccagaagggagaccaggga

SEQ ID NO: 8928 - DNA, 19 bp, Artificial sequence
  synthetic sequence
ccctgccccagaagtcaca

SEQ ID NO: 8929 - DNA, 18 bp, Artificial sequence
  synthetic sequence
acgtcaacggcacggcaa

SEQ ID NO: 8930 - DNA, 21 bp, Artificial sequence
  synthetic sequence
ctcgctcatcaatggggacga

SEQ ID NO: 8931 - DNA, 20 bp, Artificial sequence
  synthetic sequence
ctgcagtggactcagaggga

SEQ ID NO: 8932 - DNA, 20 bp, Artificial sequence
  synthetic sequence
gccgcaactgctccacggaa

SEQ ID NO: 8933 - DNA, 20 bp, Artificial sequence
  synthetic sequence
ctccactcccgagatccaga

SEQ ID NO: 8934 - DNA, 18 bp, Artificial sequence
  synthetic sequence
caggttgaagcagcccga

SEQ ID NO: 8935 - DNA, 18 bp, Artificial sequence
  synthetic sequence
tggccacgggacaacaca

SEQ ID NO: 8936 - DNA, 20 bp, Artificial sequence
  synthetic sequence
aactggatggcagaagcaga

SEQ ID NO: 8937 - DNA, 20 bp, Artificial sequence
  synthetic sequence
gatgaccaagagggtggaca

SEQ ID NO: 8938 - DNA, 18 bp, Artificial sequence
  synthetic sequence
ggtcagcgcagaggagga

SEQ ID NO: 8939 - DNA, 20 bp, Artificial sequence
  synthetic sequence
attcgccagccaaagtagga

SEQ ID NO: 8940 - DNA, 20 bp, Artificial sequence
  synthetic sequence
gtgacaggcatcatcaccca

SEQ ID NO: 8941 - DNA, 22 bp, Artificial sequence
  synthetic sequence
ttgagcaacattggcagcctga

SEQ ID NO: 8942 - DNA, 20 bp, Artificial sequence
  synthetic sequence
cacaggctgtcagctgcaga

SEQ ID NO: 8943 - DNA, 18 bp, Artificial sequence
  synthetic sequence
cgaggcctcagagggcaa

SEQ ID NO: 8944 - DNA, 18 bp, Artificial sequence
  synthetic sequence
gagccacaacacccagca

SEQ ID NO: 8945 - DNA, 20 bp, Artificial sequence
  synthetic sequence
ccagggaccgtggagacaca

SEQ ID NO: 8946 - DNA, 18 bp, Artificial sequence
  synthetic sequence
cgggatgtatcagcccca

SEQ ID NO: 8947 - DNA, 18 bp, Artificial sequence
  synthetic sequence
actgcctgcccgaaccaa

SEQ ID NO: 8948 - DNA, 21 bp, Artificial sequence
  synthetic sequence
cataggacacgaaatcaccca

SEQ ID NO: 8949 - DNA, 23 bp, Artificial sequence
  synthetic sequence
ccaaatactgtgcagccgcagaa

SEQ ID NO: 8950 - DNA, 22 bp, Artificial sequence
  synthetic sequence
ctgagaggctccgagaaatgca

SEQ ID NO: 8951 - DNA, 20 bp, Artificial sequence
  synthetic sequence
atgtcccaggtgggaaagga

SEQ ID NO: 8952 - DNA, 20 bp, Artificial sequence
  synthetic sequence
cacgagtgctatcaccccaa

SEQ ID NO: 8953 - DNA, 18 bp, Artificial sequence
  synthetic sequence
acctggaccaggaaccga

SEQ ID NO: 8954 - DNA, 18 bp, Artificial sequence
  synthetic sequence
ctagggtggagaccgcca

SEQ ID NO: 8955 - DNA, 18 bp, Artificial sequence
  synthetic sequence
tgctcaacacggtgcaga

SEQ ID NO: 8956 - DNA, 21 bp, Artificial sequence
  synthetic sequence
gccaggaaaggacgcgtcgaa

SEQ ID NO: 8957 - DNA, 20 bp, Artificial sequence
  synthetic sequence
tccactactcccaagggcaa

SEQ ID NO: 8958 - DNA, 20 bp, Artificial sequence
  synthetic sequence
caggtgaagaacccacctga

SEQ ID NO: 8959 - DNA, 18 bp, Artificial sequence
  synthetic sequence
acctatcaggcgtgggca

SEQ ID NO: 8960 - DNA, 18 bp, Artificial sequence
  synthetic sequence
gacgactcccgaacccaa

SEQ ID NO: 8961 - DNA, 20 bp, Artificial sequence
  synthetic sequence
taccatggcagctgtcccca

SEQ ID NO: 8962 - DNA, 21 bp, Artificial sequence
  synthetic sequence
tcaaccacgtcatcctggcca

SEQ ID NO: 8963 - DNA, 20 bp, Artificial sequence
  synthetic sequence
agagccaatgaaaggcccta

SEQ ID NO: 8964 - DNA, 18 bp, Artificial sequence
  synthetic sequence
ctcatccccaccactgca

SEQ ID NO: 8965 - DNA, 19 bp, Artificial sequence
  synthetic sequence
ggaaggggccagctagaca

SEQ ID NO: 8966 - DNA, 22 bp, Artificial sequence
  synthetic sequence
ggaagccaacctcatggacaca

SEQ ID NO: 8967 - DNA, 18 bp, Artificial sequence
  synthetic sequence
tgagagctgccagcacga

SEQ ID NO: 8968 - DNA, 20 bp, Artificial sequence
  synthetic sequence
gtccacgacgtggagacaca

SEQ ID NO: 8969 - DNA, 22 bp, Artificial sequence
  synthetic sequence
caaatggccagcacaatcccca

SEQ ID NO: 8970 - DNA, 18 bp, Artificial sequence
  synthetic sequence
cttgagcctcacgacgca

SEQ ID NO: 8971 - DNA, 20 bp, Artificial sequence
  synthetic sequence
ccactgtgcgggagatagca

SEQ ID NO: 8972 - DNA, 18 bp, Artificial sequence
  synthetic sequence
ccaggcccagaccccaca

SEQ ID NO: 8973 - DNA, 18 bp, Artificial sequence
  synthetic sequence
ttacccgaacccaggcca

SEQ ID NO: 8974 - DNA, 18 bp, Artificial sequence
  synthetic sequence
caagaaccgcctgcagca

SEQ ID NO: 8975 - DNA, 20 bp, Artificial sequence
  synthetic sequence
gaaagcaacgtgccctggca

SEQ ID NO: 8976 - DNA, 18 bp, Artificial sequence
  synthetic sequence
ggcagagatcgagcggaa

SEQ ID NO: 8977 - DNA, 18 bp, Artificial sequence
  synthetic sequence
tgccaccctggagaccaa

SEQ ID NO: 8978 - DNA, 18 bp, Artificial sequence
  synthetic sequence
gcccaagcagctgaagga

SEQ ID NO: 8979 - DNA, 22 bp, Artificial sequence
  synthetic sequence
aggacacaggcacctatgagga

SEQ ID NO: 8980 - DNA, 22 bp, Artificial sequence
  synthetic sequence
aaagcggagaaatgccagcaga

SEQ ID NO: 8981 - DNA, 20 bp, Artificial sequence
  synthetic sequence
ccagtgcactccggtcccaa

SEQ ID NO: 8982 - DNA, 22 bp, Artificial sequence
  synthetic sequence
agatgagcctcctcctgagaga

SEQ ID NO: 8983 - DNA, 19 bp, Artificial sequence
  synthetic sequence
gcccctctaactgcagcca

SEQ ID NO: 8984 - DNA, 18 bp, Artificial sequence
  synthetic sequence
ccaccagtcccaaaggca

SEQ ID NO: 8985 - DNA, 19 bp, Artificial sequence
  synthetic sequence
ggcagtgagtcagaggcca

SEQ ID NO: 8986 - DNA, 18 bp, Artificial sequence
  synthetic sequence
gctctccagaacccgcca

SEQ ID NO: 8987 - DNA, 20 bp, Artificial sequence
  synthetic sequence
gctgacaagcgggacccaga

SEQ ID NO: 8988 - DNA, 21 bp, Artificial sequence
  synthetic sequence
caccagccttgcacctgaaga

SEQ ID NO: 8989 - DNA, 21 bp, Artificial sequence
  synthetic sequence
agacaagcccctgagtctcca

SEQ ID NO: 8990 - DNA, 19 bp, Artificial sequence
  synthetic sequence
gcacatccgggacgtgcga

SEQ ID NO: 8991 - DNA, 18 bp, Artificial sequence
  synthetic sequence
gccttgcgagacaaccca

SEQ ID NO: 8992 - DNA, 18 bp, Artificial sequence
  synthetic sequence
ccgagagcagtgccagga

SEQ ID NO: 8993 - DNA, 20 bp, Artificial sequence
  synthetic sequence
caactggtacctgcagcgga

SEQ ID NO: 8994 - DNA, 18 bp, Artificial sequence
  synthetic sequence
cctggtcccatggaacca

SEQ ID NO: 8995 - DNA, 22 bp, Artificial sequence
  synthetic sequence
cagatttgctagaggaaggcga

SEQ ID NO: 8996 - DNA, 19 bp, Artificial sequence
  synthetic sequence
gcctcctaccaggaagcca

SEQ ID NO: 8997 - DNA, 18 bp, Artificial sequence
  synthetic sequence
tcaccagcgtgggaagca

SEQ ID NO: 8998 - DNA, 20 bp, Artificial sequence
  synthetic sequence
accaacgtgacacaggagca

SEQ ID NO: 8999 - DNA, 18 bp, Artificial sequence
  synthetic sequence
gccactcacttgccccaa

SEQ ID NO: 9000 - DNA, 22 bp, Artificial sequence
  synthetic sequence
caatccgttcgaaataccccca

SEQ ID NO: 9001 - DNA, 21 bp, Artificial sequence
  synthetic sequence
ctccaacccagcacatccaga

SEQ ID NO: 9002 - DNA, 18 bp, Artificial sequence
  synthetic sequence
acacgaaccgtccgccga

SEQ ID NO: 9003 - DNA, 22 bp, Artificial sequence
  synthetic sequence
ctgggaagagatgatggtggca

SEQ ID NO: 9004 - DNA, 19 bp, Artificial sequence
  synthetic sequence
cgggacacccagatcagca

SEQ ID NO: 9005 - DNA, 19 bp, Artificial sequence
  synthetic sequence
ctctgcctcggtctgagga

SEQ ID NO: 9006 - DNA, 18 bp, Artificial sequence
  synthetic sequence
gctaccagcccgagcaca

SEQ ID NO: 9007 - DNA, 20 bp, Artificial sequence
  synthetic sequence
gggagcagagcctgagacga

SEQ ID NO: 9008 - DNA, 18 bp, Artificial sequence
  synthetic sequence
acgccggcaagaagcgaa

SEQ ID NO: 9009 - DNA, 20 bp, Artificial sequence
  synthetic sequence
aataccagacgacccccaga

SEQ ID NO: 9010 - DNA, 18 bp, Artificial sequence
  synthetic sequence
caccaatgggtggcacca

SEQ ID NO: 9011 - DNA, 21 bp, Artificial sequence
  synthetic sequence
tcgctgcaggcacacgacaca

SEQ ID NO: 9012 - DNA, 18 bp, Artificial sequence
  synthetic sequence
gcacctggccttccagca

SEQ ID NO: 9013 - DNA, 18 bp, Artificial sequence
  synthetic sequence
gagatccacgggaaggca

SEQ ID NO: 9014 - DNA, 18 bp, Artificial sequence
  synthetic sequence
gtgctgcgggatcagcaa

SEQ ID NO: 9015 - DNA, 20 bp, Artificial sequence
  synthetic sequence
cacaggacccaactgcgaga

SEQ ID NO: 9016 - DNA, 18 bp, Artificial sequence
  synthetic sequence
cccattgatcgacggcca

SEQ ID NO: 9017 - DNA, 19 bp, Artificial sequence
  synthetic sequence
tgcaacccggtgtacgaga

SEQ ID NO: 9018 - DNA, 19 bp, Artificial sequence
  synthetic sequence
cctctgactccggaaggca

SEQ ID NO: 9019 - DNA, 22 bp, Artificial sequence
  synthetic sequence
caaagacaagccaaagtgcgga

SEQ ID NO: 9020 - DNA, 18 bp, Artificial sequence
  synthetic sequence
cctggaccggggaagtca

SEQ ID NO: 9021 - DNA, 20 bp, Artificial sequence
  synthetic sequence
ctggacccagagcaaggaca

SEQ ID NO: 9022 - DNA, 18 bp, Artificial sequence
  synthetic sequence
ggtcaacgccatgcacca

SEQ ID NO: 9023 - DNA, 20 bp, Artificial sequence
  synthetic sequence
catggcatgaccagtggaga

SEQ ID NO: 9024 - DNA, 19 bp, Artificial sequence
  synthetic sequence
tgtcagcgctcctaaagca

SEQ ID NO: 9025 - DNA, 21 bp, Artificial sequence
  synthetic sequence
aggacggagagaagctgggca

SEQ ID NO: 9026 - DNA, 22 bp, Artificial sequence
  synthetic sequence
agtacaggtccagtgaaaccaa

SEQ ID NO: 9027 - DNA, 20 bp, Artificial sequence
  synthetic sequence
ctgtcatggaccccaggcga

SEQ ID NO: 9028 - DNA, 19 bp, Artificial sequence
  synthetic sequence
ggtgggaagcaccgagaga

SEQ ID NO: 9029 - DNA, 18 bp, Artificial sequence
  synthetic sequence
accgaagaggaggccaca

SEQ ID NO: 9030 - DNA, 18 bp, Artificial sequence
  synthetic sequence
cgtgcaccgctacggcca

SEQ ID NO: 9031 - DNA, 20 bp, Artificial sequence
  synthetic sequence
tagcctcacctgcatagcaa

SEQ ID NO: 9032 - DNA, 18 bp, Artificial sequence
  synthetic sequence
cgacccgcgacgggcaca

SEQ ID NO: 9033 - DNA, 18 bp, Artificial sequence
  synthetic sequence
actgccagaacggaggga

SEQ ID NO: 9034 - DNA, 20 bp, Artificial sequence
  synthetic sequence
actgaaggaggcgtccgaga

SEQ ID NO: 9035 - DNA, 19 bp, Artificial sequence
  synthetic sequence
cgagagccccacatgagga

SEQ ID NO: 9036 - DNA, 18 bp, Artificial sequence
  synthetic sequence
agacctggccaccaggaa

SEQ ID NO: 9037 - DNA, 21 bp, Artificial sequence
  synthetic sequence
tcttctacgtcagctccacca

SEQ ID NO: 9038 - DNA, 19 bp, Artificial sequence
  synthetic sequence
gaggcagaggtgacacgga

SEQ ID NO: 9039 - DNA, 18 bp, Artificial sequence
  synthetic sequence
tcctccacatcgacccca

SEQ ID NO: 9040 - DNA, 20 bp, Artificial sequence
  synthetic sequence
caccaagaggaagccgtcca

SEQ ID NO: 9041 - DNA, 20 bp, Artificial sequence
  synthetic sequence
agctacagcaatgcgggcga

SEQ ID NO: 9042 - DNA, 21 bp, Artificial sequence
  synthetic sequence
caccttcctctacttggacca

SEQ ID NO: 9043 - DNA, 18 bp, Artificial sequence
  synthetic sequence
ccatcctcaagacccgca

SEQ ID NO: 9044 - DNA, 18 bp, Artificial sequence
  synthetic sequence
caaccagcaggaaggcca

SEQ ID NO: 9045 - DNA, 19 bp, Artificial sequence
  synthetic sequence
gcggacctgagcacacaga

SEQ ID NO: 9046 - DNA, 18 bp, Artificial sequence
  synthetic sequence
cctggcagctgatgagga

SEQ ID NO: 9047 - DNA, 18 bp, Artificial sequence
  synthetic sequence
catggatggcctccgcga

SEQ ID NO: 9048 - DNA, 21 bp, Artificial sequence
  synthetic sequence
tgaaggaccagcctgatgaga

SEQ ID NO: 9049 - DNA, 18 bp, Artificial sequence
  synthetic sequence
ggaacaccaatgccagca

SEQ ID NO: 9050 - DNA, 18 bp, Artificial sequence
  synthetic sequence
cgtgggaggccaagagca

SEQ ID NO: 9051 - DNA, 20 bp, Artificial sequence
  synthetic sequence
cagtaccgccactccgcgca

SEQ ID NO: 9052 - DNA, 20 bp, Artificial sequence
  synthetic sequence
aacccagtagaggcaccaca

SEQ ID NO: 9053 - DNA, 20 bp, Artificial sequence
  synthetic sequence
cttcggcagcagtccgcaca

SEQ ID NO: 9054 - DNA, 18 bp, Artificial sequence
  synthetic sequence
ttcccggaccaggggcca

SEQ ID NO: 9055 - DNA, 20 bp, Artificial sequence
  synthetic sequence
gggcctgcatcaccacctca

SEQ ID NO: 9056 - DNA, 21 bp, Artificial sequence
  synthetic sequence
aagggatcagtgagaggcaga

SEQ ID NO: 9057 - DNA, 20 bp, Artificial sequence
  synthetic sequence
acatagcccaggccacagca

SEQ ID NO: 9058 - DNA, 18 bp, Artificial sequence
  synthetic sequence
gctgttgcgcacggagga

SEQ ID NO: 9059 - DNA, 18 bp, Artificial sequence
  synthetic sequence
gctggggcaagaaggcaa

SEQ ID NO: 9060 - DNA, 21 bp, Artificial sequence
  synthetic sequence
gaagaactcactgcagagcga

SEQ ID NO: 9061 - DNA, 21 bp, Artificial sequence
  synthetic sequence
agaccaccaccacctttccca

SEQ ID NO: 9062 - DNA, 19 bp, Artificial sequence
  synthetic sequence
cctgcccctcaactaccca

SEQ ID NO: 9063 - DNA, 20 bp, Artificial sequence
  synthetic sequence
tccagaggcagtgaccagca

SEQ ID NO: 9064 - DNA, 19 bp, Artificial sequence
  synthetic sequence
cctcccctcaactccacca

SEQ ID NO: 9065 - DNA, 18 bp, Artificial sequence
  synthetic sequence
ccagcagcagcatccaca

SEQ ID NO: 9066 - DNA, 21 bp, Artificial sequence
  synthetic sequence
tgtgaccatctgcagccccaa

SEQ ID NO: 9067 - DNA, 19 bp, Artificial sequence
  synthetic sequence
cagcgaggagagaggccaa

SEQ ID NO: 9068 - DNA, 20 bp, Artificial sequence
  synthetic sequence
cacatcccactcacccagga

SEQ ID NO: 9069 - DNA, 20 bp, Artificial sequence
  synthetic sequence
agtcctgacctggccaagca

SEQ ID NO: 9070 - DNA, 19 bp, Artificial sequence
  synthetic sequence
cctgaaggaggacccctca

SEQ ID NO: 9071 - DNA, 19 bp, Artificial sequence
  synthetic sequence
ccacaccgtgaaagagcca

SEQ ID NO: 9072 - DNA, 19 bp, Artificial sequence
  synthetic sequence
gagacgacccggaaggaga

SEQ ID NO: 9073 - DNA, 18 bp, Artificial sequence
  synthetic sequence
tgggtaccggatggccaa

SEQ ID NO: 9074 - DNA, 19 bp, Artificial sequence
  synthetic sequence
tcagctaccaggtggccaa

SEQ ID NO: 9075 - DNA, 18 bp, Artificial sequence
  synthetic sequence
cccctgatccatgaccga

SEQ ID NO: 9076 - DNA, 18 bp, Artificial sequence
  synthetic sequence
gactcacctggcccagga

SEQ ID NO: 9077 - DNA, 20 bp, Artificial sequence
  synthetic sequence
tcctccaagtccctgcccaa

SEQ ID NO: 9078 - DNA, 21 bp, Artificial sequence
  synthetic sequence
caagtacatccgtgcccccaa

SEQ ID NO: 9079 - DNA, 18 bp, Artificial sequence
  synthetic sequence
ctggtgaacctgccgaca

SEQ ID NO: 9080 - DNA, 20 bp, Artificial sequence
  synthetic sequence
cagcacaaggccgccttcca

SEQ ID NO: 9081 - DNA, 18 bp, Artificial sequence
  synthetic sequence
aaggtgactgcccagcca

SEQ ID NO: 9082 - DNA, 18 bp, Artificial sequence
  synthetic sequence
tgcggaggcttcagcaga

SEQ ID NO: 9083 - DNA, 18 bp, Artificial sequence
  synthetic sequence
ggccaaggaactgggcaa

SEQ ID NO: 9084 - DNA, 20 bp, Artificial sequence
  synthetic sequence
gagccggtgcagtacacaca

SEQ ID NO: 9085 - DNA, 18 bp, Artificial sequence
  synthetic sequence
ccatccagccgctgcaca

SEQ ID NO: 9086 - DNA, 18 bp, Artificial sequence
  synthetic sequence
ggtgatcagcgccacaca

SEQ ID NO: 9087 - DNA, 20 bp, Artificial sequence
  synthetic sequence
caggaccctgagctatcgga

SEQ ID NO: 9088 - DNA, 19 bp, Artificial sequence
  synthetic sequence
ggcaagaggtgggcagaca

SEQ ID NO: 9089 - DNA, 18 bp, Artificial sequence
  synthetic sequence
aggcagactgcggcctca

SEQ ID NO: 9090 - DNA, 21 bp, Artificial sequence
  synthetic sequence
caaagtccaggaagccaggaa

SEQ ID NO: 9091 - DNA, 19 bp, Artificial sequence
  synthetic sequence
gaggtccagctgtccagca

SEQ ID NO: 9092 - DNA, 22 bp, Artificial sequence
  synthetic sequence
atcagaaactcagccctggaca

SEQ ID NO: 9093 - DNA, 21 bp, Artificial sequence
  synthetic sequence
cagaatctcggcgaaggagca

SEQ ID NO: 9094 - DNA, 18 bp, Artificial sequence
  synthetic sequence
tgacggtcacaggcacca

SEQ ID NO: 9095 - DNA, 20 bp, Artificial sequence
  synthetic sequence
gccccgatgatcaccccaga

SEQ ID NO: 9096 - DNA, 20 bp, Artificial sequence
  synthetic sequence
aggctcaactcactggccca

SEQ ID NO: 9097 - DNA, 19 bp, Artificial sequence
  synthetic sequence
ggagggacccaagtgacca

SEQ ID NO: 9098 - DNA, 18 bp, Artificial sequence
  synthetic sequence
ccaaactgccatgcccca

SEQ ID NO: 9099 - DNA, 18 bp, Artificial sequence
  synthetic sequence
cccacgatgccaacgaga

SEQ ID NO: 9100 - DNA, 20 bp, Artificial sequence
  synthetic sequence
tgaaagccaccgaggagcca

SEQ ID NO: 9101 - DNA, 18 bp, Artificial sequence
  synthetic sequence
gcgagctccggaaagaga

SEQ ID NO: 9102 - DNA, 20 bp, Artificial sequence
  synthetic sequence
gggaatctccgaccccgaca

SEQ ID NO: 9103 - DNA, 20 bp, Artificial sequence
  synthetic sequence
tctgccactgaatctggcta

SEQ ID NO: 9104 - DNA, 21 bp, Artificial sequence
  synthetic sequence
catgggtaccacactggcaga

SEQ ID NO: 9105 - DNA, 23 bp, Artificial sequence
  synthetic sequence
gcaacacgaagcttccagaacca

SEQ ID NO: 9106 - DNA, 18 bp, Artificial sequence
  synthetic sequence
gccgagcagtcaaagcca

SEQ ID NO: 9107 - DNA, 21 bp, Artificial sequence
  synthetic sequence
gcatatgcctcccagagagga

SEQ ID NO: 9108 - DNA, 18 bp, Artificial sequence
  synthetic sequence
aggccgacctggagcaca

SEQ ID NO: 9109 - DNA, 20 bp, Artificial sequence
  synthetic sequence
gtgaaccatccagatgccaa

SEQ ID NO: 9110 - DNA, 20 bp, Artificial sequence
  synthetic sequence
cagcaaaccaccttcacgga

SEQ ID NO: 9111 - DNA, 20 bp, Artificial sequence
  synthetic sequence
tgcacagggccgcaagcgca

SEQ ID NO: 9112 - DNA, 20 bp, Artificial sequence
  synthetic sequence
cgcgctggccaacctcaaga

SEQ ID NO: 9113 - DNA, 25 bp, Artificial sequence
  synthetic sequence
aggagctagggaaagaaaacctgga

SEQ ID NO: 9114 - DNA, 20 bp, Artificial sequence
  synthetic sequence
caatgccacaccagagcaga

SEQ ID NO: 9115 - DNA, 18 bp, Artificial sequence
  synthetic sequence
cctggagaacgtgccaca

SEQ ID NO: 9116 - DNA, 20 bp, Artificial sequence
  synthetic sequence
atctccaactacggcaccca

SEQ ID NO: 9117 - DNA, 19 bp, Artificial sequence
  synthetic sequence
ggaggtgctacaggggcaa

SEQ ID NO: 9118 - DNA, 20 bp, Artificial sequence
  synthetic sequence
cagtcagtggaacaagccga

SEQ ID NO: 9119 - DNA, 20 bp, Artificial sequence
  synthetic sequence
ctcggtatgaactgcgggaa

SEQ ID NO: 9120 - DNA, 20 bp, Artificial sequence
  synthetic sequence
gaccaaagaggcgttggaga

SEQ ID NO: 9121 - DNA, 19 bp, Artificial sequence
  synthetic sequence
gaggaggtgactcagcgca

SEQ ID NO: 9122 - DNA, 18 bp, Artificial sequence
  synthetic sequence
gccgaagcgagaaggcaa

SEQ ID NO: 9123 - DNA, 20 bp, Artificial sequence
  synthetic sequence
gtgagccctcctgctaagca

SEQ ID NO: 9124 - DNA, 22 bp, Artificial sequence
  synthetic sequence
ggaatcagcccaacgatcaaga

SEQ ID NO: 9125 - DNA, 18 bp, Artificial sequence
  synthetic sequence
ccaacacagtgcccgaca

SEQ ID NO: 9126 - DNA, 20 bp, Artificial sequence
  synthetic sequence
cacaggcctggtgctcaaga

SEQ ID NO: 9127 - DNA, 21 bp, Artificial sequence
  synthetic sequence
cagcaaaaagcccacccagga

SEQ ID NO: 9128 - DNA, 18 bp, Artificial sequence
  synthetic sequence
gccacagcaacaccagca

SEQ ID NO: 9129 - DNA, 19 bp, Artificial sequence
  synthetic sequence
gaggagacggaccacctca

SEQ ID NO: 9130 - DNA, 18 bp, Artificial sequence
  synthetic sequence
gggccagtacaccgtcca

SEQ ID NO: 9131 - DNA, 20 bp, Artificial sequence
  synthetic sequence
ctggcagaaggaggcagaga

SEQ ID NO: 9132 - DNA, 18 bp, Artificial sequence
  synthetic sequence
gcgcaccggagaggacga

SEQ ID NO: 9133 - DNA, 19 bp, Artificial sequence
  synthetic sequence
cccctcagcaccaagcaga

SEQ ID NO: 9134 - DNA, 18 bp, Artificial sequence
  synthetic sequence
agtcagggaaccacccca

SEQ ID NO: 9135 - DNA, 20 bp, Artificial sequence
  synthetic sequence
aagtcacagcggagagcaga

SEQ ID NO: 9136 - DNA, 18 bp, Artificial sequence
  synthetic sequence
caccagctggccagacca

SEQ ID NO: 9137 - DNA, 19 bp, Artificial sequence
  synthetic sequence
gggagcatggagaggagca

SEQ ID NO: 9138 - DNA, 18 bp, Artificial sequence
  synthetic sequence
agaccctgccacgagcaa

SEQ ID NO: 9139 - DNA, 18 bp, Artificial sequence
  synthetic sequence
gatcccaagaggcccgaa

SEQ ID NO: 9140 - DNA, 20 bp, Artificial sequence
  synthetic sequence
cagcgaatggcacagaagga

SEQ ID NO: 9141 - DNA, 20 bp, Artificial sequence
  synthetic sequence
caagagagaagccggagcca

SEQ ID NO: 9142 - DNA, 18 bp, Artificial sequence
  synthetic sequence
cgatggggagagcagcaa

SEQ ID NO: 9143 - DNA, 20 bp, Artificial sequence
  synthetic sequence
ggccagaggacaacaagcca

SEQ ID NO: 9144 - DNA, 20 bp, Artificial sequence
  synthetic sequence
cagttcacagactggccgga

SEQ ID NO: 9145 - DNA, 19 bp, Artificial sequence
  synthetic sequence
ggaggagtgacggcaggaa

SEQ ID NO: 9146 - DNA, 18 bp, Artificial sequence
  synthetic sequence
ggccgacgccgtactgga

SEQ ID NO: 9147 - DNA, 18 bp, Artificial sequence
  synthetic sequence
agcaacccagagcccaca

SEQ ID NO: 9148 - DNA, 20 bp, Artificial sequence
  synthetic sequence
ctgtgacgcctcaggacaga

SEQ ID NO: 9149 - DNA, 18 bp, Artificial sequence
  synthetic sequence
cgctagccacttcgagca

SEQ ID NO: 9150 - DNA, 21 bp, Artificial sequence
  synthetic sequence
ccaggggtgaggaagaggaga

SEQ ID NO: 9151 - DNA, 19 bp, Artificial sequence
  synthetic sequence
tccaggaagcacaagccta

SEQ ID NO: 9152 - DNA, 18 bp, Artificial sequence
  synthetic sequence
ccaccctcagtccctgca

SEQ ID NO: 9153 - DNA, 18 bp, Artificial sequence
  synthetic sequence
caccggcatccacaggca

SEQ ID NO: 9154 - DNA, 18 bp, Artificial sequence
  synthetic sequence
cccagcatgtgttccgca

SEQ ID NO: 9155 - DNA, 20 bp, Artificial sequence
  synthetic sequence
tatcaactctgacagcccga

SEQ ID NO: 9156 - DNA, 21 bp, Artificial sequence
  synthetic sequence
aagtccagagagagcagacca

SEQ ID NO: 9157 - DNA, 18 bp, Artificial sequence
  synthetic sequence
tcatcccagcggtgggaa

SEQ ID NO: 9158 - DNA, 20 bp, Artificial sequence
  synthetic sequence
ctgcttccctgaggaggaga

SEQ ID NO: 9159 - DNA, 20 bp, Artificial sequence
  synthetic sequence
gtgccagagcgtcacctcca

SEQ ID NO: 9160 - DNA, 18 bp, Artificial sequence
  synthetic sequence
tcacaggcaacctcgcca

SEQ ID NO: 9161 - DNA, 18 bp, Artificial sequence
  synthetic sequence
ctgacagcaaacccccga

SEQ ID NO: 9162 - DNA, 18 bp, Artificial sequence
  synthetic sequence
cttcatccgcgcacggaa

SEQ ID NO: 9163 - DNA, 19 bp, Artificial sequence
  synthetic sequence
tatcggaatcccgctcaca

SEQ ID NO: 9164 - DNA, 18 bp, Artificial sequence
  synthetic sequence
aagatcagccctcggcga

SEQ ID NO: 9165 - DNA, 22 bp, Artificial sequence
  synthetic sequence
tacgggaacatcaccttgccca

SEQ ID NO: 9166 - DNA, 18 bp, Artificial sequence
  synthetic sequence
ggatacggatgcgccaga

SEQ ID NO: 9167 - DNA, 20 bp, Artificial sequence
  synthetic sequence
ctgaagactgcccacccaga

SEQ ID NO: 9168 - DNA, 21 bp, Artificial sequence
  synthetic sequence
tgacacacagaacgccccaga

SEQ ID NO: 9169 - DNA, 19 bp, Artificial sequence
  synthetic sequence
ggagcctgtgtagccagca

SEQ ID NO: 9170 - DNA, 18 bp, Artificial sequence
  synthetic sequence
cagccgcagaagccagga

SEQ ID NO: 9171 - DNA, 21 bp, Artificial sequence
  synthetic sequence
gaggagactgtgctggcaaca

SEQ ID NO: 9172 - DNA, 18 bp, Artificial sequence
  synthetic sequence
cacgacggcaagcaggca

SEQ ID NO: 9173 - DNA, 20 bp, Artificial sequence
  synthetic sequence
aggccaggctgttcacgcaa

SEQ ID NO: 9174 - DNA, 21 bp, Artificial sequence
  synthetic sequence
gtccacagtccacggtacaca

SEQ ID NO: 9175 - DNA, 21 bp, Artificial sequence
  synthetic sequence
gccagactccctacgtggaca

SEQ ID NO: 9176 - DNA, 22 bp, Artificial sequence
  synthetic sequence
ctacacgcagtcagaaacggaa

SEQ ID NO: 9177 - DNA, 21 bp, Artificial sequence
  synthetic sequence
ccgtctacagggatgacctga

SEQ ID NO: 9178 - DNA, 18 bp, Artificial sequence
  synthetic sequence
actccggcaccaacccca

SEQ ID NO: 9179 - DNA, 20 bp, Artificial sequence
  synthetic sequence
ctgcctctctacgccaagca

SEQ ID NO: 9180 - DNA, 20 bp, Artificial sequence
  synthetic sequence
gtccatggcactgctgcgga

SEQ ID NO: 9181 - DNA, 19 bp, Artificial sequence
  synthetic sequence
cgtcgaggctcactccgga

SEQ ID NO: 9182 - DNA, 18 bp, Artificial sequence
  synthetic sequence
ctgcggggaccacctcga

SEQ ID NO: 9183 - DNA, 20 bp, Artificial sequence
  synthetic sequence
aatggctcaggtccgcacga

SEQ ID NO: 9184 - DNA, 18 bp, Artificial sequence
  synthetic sequence
cggtcacgggaatcccca

SEQ ID NO: 9185 - DNA, 18 bp, Artificial sequence
  synthetic sequence
cgggacctccaggggcga

SEQ ID NO: 9186 - DNA, 20 bp, Artificial sequence
  synthetic sequence
tgccaccctcaacgtcctca

SEQ ID NO: 9187 - DNA, 18 bp, Artificial sequence
  synthetic sequence
cggcgagatggctgggca

SEQ ID NO: 9188 - DNA, 18 bp, Artificial sequence
  synthetic sequence
ggaaccgcctcaagacga

SEQ ID NO: 9189 - DNA, 20 bp, Artificial sequence
  synthetic sequence
tgctgaggatggagcctcca

SEQ ID NO: 9190 - DNA, 22 bp, Artificial sequence
  synthetic sequence
atgtaccttgacaacagctcca

SEQ ID NO: 9191 - DNA, 21 bp, Artificial sequence
  synthetic sequence
tcagctcaagtggaagcccca

SEQ ID NO: 9192 - DNA, 21 bp, Artificial sequence
  synthetic sequence
ggtacagctctgccatcgcca

SEQ ID NO: 9193 - DNA, 19 bp, Artificial sequence
  synthetic sequence
tccatttgacacaccccca

SEQ ID NO: 9194 - DNA, 18 bp, Artificial sequence
  synthetic sequence
agctgaagccagcccaga

SEQ ID NO: 9195 - DNA, 18 bp, Artificial sequence
  synthetic sequence
gggacaacgagaagccca

SEQ ID NO: 9196 - DNA, 20 bp, Artificial sequence
  synthetic sequence
caaggaggactgcgtggaga

SEQ ID NO: 9197 - DNA, 19 bp, Artificial sequence
  synthetic sequence
ctgcacaaacagcatgcca

SEQ ID NO: 9198 - DNA, 18 bp, Artificial sequence
  synthetic sequence
tcccatggcagccagcaa

SEQ ID NO: 9199 - DNA, 18 bp, Artificial sequence
  synthetic sequence
ggcaattccagaggcgaa

SEQ ID NO: 9200 - DNA, 18 bp, Artificial sequence
  synthetic sequence
acggacaaatggtcccca

SEQ ID NO: 9201 - DNA, 18 bp, Artificial sequence
  synthetic sequence
tggacagccaggaccaga

SEQ ID NO: 9202 - DNA, 20 bp, Artificial sequence
  synthetic sequence
gtagccagctactgcccaga

SEQ ID NO: 9203 - DNA, 19 bp, Artificial sequence
  synthetic sequence
ggccctgtcctgaaccaga

SEQ ID NO: 9204 - DNA, 18 bp, Artificial sequence
  synthetic sequence
gcgtgttgaaggccgaga

SEQ ID NO: 9205 - DNA, 18 bp, Artificial sequence
  synthetic sequence
ggacacctccaccgagca

SEQ ID NO: 9206 - DNA, 18 bp, Artificial sequence
  synthetic sequence
gcctgagcacagtggcaa

SEQ ID NO: 9207 - DNA, 18 bp, Artificial sequence
  synthetic sequence
gcaacaaccccgaaccca

SEQ ID NO: 9208 - DNA, 21 bp, Artificial sequence
  synthetic sequence
ggcttaggggactgcacagga

SEQ ID NO: 9209 - DNA, 21 bp, Artificial sequence
  synthetic sequence
acaaggagaacgtggagcaga

SEQ ID NO: 9210 - DNA, 20 bp, Artificial sequence
  synthetic sequence
gaggacttccacgtggacca

SEQ ID NO: 9211 - DNA, 20 bp, Artificial sequence
  synthetic sequence
gaggaagccttcaccagcaa

SEQ ID NO: 9212 - DNA, 20 bp, Artificial sequence
  synthetic sequence
tcagcgcacacctgtacaga

SEQ ID NO: 9213 - DNA, 18 bp, Artificial sequence
  synthetic sequence
gtcgacaagtgcccccaa

SEQ ID NO: 9214 - DNA, 18 bp, Artificial sequence
  synthetic sequence
aagctcgccaggtccaca

SEQ ID NO: 9215 - DNA, 21 bp, Artificial sequence
  synthetic sequence
cagcaccagacagtgctggaa

SEQ ID NO: 9216 - DNA, 20 bp, Artificial sequence
  synthetic sequence
caaaatgtagccgtggccaa

SEQ ID NO: 9217 - DNA, 18 bp, Artificial sequence
  synthetic sequence
aggtcccgaggaacgaca

SEQ ID NO: 9218 - DNA, 18 bp, Artificial sequence
  synthetic sequence
agaatggctgccgcgaga

SEQ ID NO: 9219 - DNA, 18 bp, Artificial sequence
  synthetic sequence
ttccaggccaagcccgca

SEQ ID NO: 9220 - DNA, 19 bp, Artificial sequence
  synthetic sequence
gcacacaggctggtggaca

SEQ ID NO: 9221 - DNA, 21 bp, Artificial sequence
  synthetic sequence
agaaggctgttgagagaagga

SEQ ID NO: 9222 - DNA, 20 bp, Artificial sequence
  synthetic sequence
gaagccacctgcaggacaga

SEQ ID NO: 9223 - DNA, 18 bp, Artificial sequence
  synthetic sequence
atgtgctgccgacgggaa

SEQ ID NO: 9224 - DNA, 21 bp, Artificial sequence
  synthetic sequence
tgagagccagtgaagatggca

SEQ ID NO: 9225 - DNA, 19 bp, Artificial sequence
  synthetic sequence
gcagagtcgagggagcaca

SEQ ID NO: 9226 - DNA, 20 bp, Artificial sequence
  synthetic sequence
ctggcgtctacacctgccaa

SEQ ID NO: 9227 - DNA, 18 bp, Artificial sequence
  synthetic sequence
catcctgcagctgccaga

SEQ ID NO: 9228 - DNA, 18 bp, Artificial sequence
  synthetic sequence
ggaagggggattcaggga

SEQ ID NO: 9229 - DNA, 20 bp, Artificial sequence
  synthetic sequence
ctggaggggaacagcagcca

SEQ ID NO: 9230 - DNA, 18 bp, Artificial sequence
  synthetic sequence
ccaggaccacagcaccaa

SEQ ID NO: 9231 - DNA, 21 bp, Artificial sequence
  synthetic sequence
agccagactgactctgaccca

SEQ ID NO: 9232 - DNA, 19 bp, Artificial sequence
  synthetic sequence
ggggagggacctggtggga

SEQ ID NO: 9233 - DNA, 20 bp, Artificial sequence
  synthetic sequence
ggcccaacatcctcatccca

SEQ ID NO: 9234 - DNA, 18 bp, Artificial sequence
  synthetic sequence
agcccacccgaaggagca

SEQ ID NO: 9235 - DNA, 20 bp, Artificial sequence
  synthetic sequence
ggagactcacaggagtggca

SEQ ID NO: 9236 - DNA, 18 bp, Artificial sequence
  synthetic sequence
gcatccgcagcacagcca

SEQ ID NO: 9237 - DNA, 18 bp, Artificial sequence
  synthetic sequence
aggagaacgggacctgca

SEQ ID NO: 9238 - DNA, 22 bp, Artificial sequence
  synthetic sequence
atgggaggccttgggaaacaca

SEQ ID NO: 9239 - DNA, 19 bp, Artificial sequence
  synthetic sequence
aagcagccaatgagtccca

SEQ ID NO: 9240 - DNA, 18 bp, Artificial sequence
  synthetic sequence
ggcgacgggagacaacca

SEQ ID NO: 9241 - DNA, 21 bp, Artificial sequence
  synthetic sequence
agagcgagacagagaggcaca

SEQ ID NO: 9242 - DNA, 19 bp, Artificial sequence
  synthetic sequence
gacaccgtccgcgacacca

SEQ ID NO: 9243 - DNA, 18 bp, Artificial sequence
  synthetic sequence
ggaccctgtacagccgca

SEQ ID NO: 9244 - DNA, 22 bp, Artificial sequence
  synthetic sequence
gataatccatggacagggggca

SEQ ID NO: 9245 - DNA, 22 bp, Artificial sequence
  synthetic sequence
caaattcaactgggacccggaa

SEQ ID NO: 9246 - DNA, 20 bp, Artificial sequence
  synthetic sequence
aagcacaagactcgggagga

SEQ ID NO: 9247 - DNA, 18 bp, Artificial sequence
  synthetic sequence
gacaagcgcgtcaccaga

SEQ ID NO: 9248 - DNA, 21 bp, Artificial sequence
  synthetic sequence
atggacaaggtcgggaggaga

SEQ ID NO: 9249 - DNA, 18 bp, Artificial sequence
  synthetic sequence
gccagctcattgggacca

SEQ ID NO: 9250 - DNA, 20 bp, Artificial sequence
  synthetic sequence
ggaaccggtgggaagacaca

SEQ ID NO: 9251 - DNA, 18 bp, Artificial sequence
  synthetic sequence
cagagaccgcaggagcca

SEQ ID NO: 9252 - DNA, 19 bp, Artificial sequence
  synthetic sequence
gctccaccagtcctgggaa

SEQ ID NO: 9253 - DNA, 18 bp, Artificial sequence
  synthetic sequence
gggtgatctgggccgaca

SEQ ID NO: 9254 - DNA, 20 bp, Artificial sequence
  synthetic sequence
ctccacgagcatcttcgaga

SEQ ID NO: 9255 - DNA, 18 bp, Artificial sequence
  synthetic sequence
aaattgggccaggcccga

SEQ ID NO: 9256 - DNA, 18 bp, Artificial sequence
  synthetic sequence
cctggggacgctcaacca

SEQ ID NO: 9257 - DNA, 18 bp, Artificial sequence
  synthetic sequence
cgtggtggtgagtggcaa

SEQ ID NO: 9258 - DNA, 18 bp, Artificial sequence
  synthetic sequence
tgacaacgtgcagtccga

SEQ ID NO: 9259 - DNA, 18 bp, Artificial sequence
  synthetic sequence
ccagtggcaccacaagca

SEQ ID NO: 9260 - DNA, 18 bp, Artificial sequence
  synthetic sequence
gaagctgcagaacgggga

SEQ ID NO: 9261 - DNA, 20 bp, Artificial sequence
  synthetic sequence
cagcgctactctcgggagga

SEQ ID NO: 9262 - DNA, 18 bp, Artificial sequence
  synthetic sequence
ctgctcagcacccagcca

SEQ ID NO: 9263 - DNA, 20 bp, Artificial sequence
  synthetic sequence
taggtacggtggcaaaagga

SEQ ID NO: 9264 - DNA, 20 bp, Artificial sequence
  synthetic sequence
cgggcccagggttatgccaa

SEQ ID NO: 9265 - DNA, 18 bp, Artificial sequence
  synthetic sequence
tcacgtcgctcagcggca

SEQ ID NO: 9266 - DNA, 21 bp, Artificial sequence
  synthetic sequence
tgaacctccaaaccccagcaa

SEQ ID NO: 9267 - DNA, 18 bp, Artificial sequence
  synthetic sequence
cctggaatcgaccaccca

SEQ ID NO: 9268 - DNA, 18 bp, Artificial sequence
  synthetic sequence
ccctggccatcatcggca

SEQ ID NO: 9269 - DNA, 18 bp, Artificial sequence
  synthetic sequence
ccatctaccacgcagcca

SEQ ID NO: 9270 - DNA, 21 bp, Artificial sequence
  synthetic sequence
gatctcccgaagccacacaga

SEQ ID NO: 9271 - DNA, 20 bp, Artificial sequence
  synthetic sequence
gatgctgctccggaggcaga

SEQ ID NO: 9272 - DNA, 19 bp, Artificial sequence
  synthetic sequence
ccccgcatagctaccacca

SEQ ID NO: 9273 - DNA, 18 bp, Artificial sequence
  synthetic sequence
cccgaaggtcaccaagca

SEQ ID NO: 9274 - DNA, 18 bp, Artificial sequence
  synthetic sequence
tcggctgggtgatcgaca

SEQ ID NO: 9275 - DNA, 21 bp, Artificial sequence
  synthetic sequence
tccgaagagaagctccggtca

SEQ ID NO: 9276 - DNA, 18 bp, Artificial sequence
  synthetic sequence
tggaccgctgaggagcaa

SEQ ID NO: 9277 - DNA, 20 bp, Artificial sequence
  synthetic sequence
caggtggccactgacaagga

SEQ ID NO: 9278 - DNA, 22 bp, Artificial sequence
  synthetic sequence
gctagaaaagcaggccacacca

SEQ ID NO: 9279 - DNA, 22 bp, Artificial sequence
  synthetic sequence
ggcatccaaatgcaatgccaca

SEQ ID NO: 9280 - DNA, 19 bp, Artificial sequence
  synthetic sequence
tccggagcacccttagcta

SEQ ID NO: 9281 - DNA, 18 bp, Artificial sequence
  synthetic sequence
cccccgggcatctcgaca

SEQ ID NO: 9282 - DNA, 21 bp, Artificial sequence
  synthetic sequence
gagcagaataccgaaggcaga

SEQ ID NO: 9283 - DNA, 18 bp, Artificial sequence
  synthetic sequence
ggccttctctaagcggca

SEQ ID NO: 9284 - DNA, 18 bp, Artificial sequence
  synthetic sequence
gggtacatcgcctgcaca

SEQ ID NO: 9285 - DNA, 20 bp, Artificial sequence
  synthetic sequence
ctcgagtaccagctgaccga

SEQ ID NO: 9286 - DNA, 19 bp, Artificial sequence
  synthetic sequence
cctcagaaccgacgccaga

SEQ ID NO: 9287 - DNA, 22 bp, Artificial sequence
  synthetic sequence
accctgaaccacccaagcaaca

SEQ ID NO: 9288 - DNA, 21 bp, Artificial sequence
  synthetic sequence
gaaccttacactgaccgggga

SEQ ID NO: 9289 - DNA, 20 bp, Artificial sequence
  synthetic sequence
cagtgggtcccagatggaga

SEQ ID NO: 9290 - DNA, 18 bp, Artificial sequence
  synthetic sequence
agccgaatgccgtaggca

SEQ ID NO: 9291 - DNA, 18 bp, Artificial sequence
  synthetic sequence
gaggtggaccgcacggaa

SEQ ID NO: 9292 - DNA, 18 bp, Artificial sequence
  synthetic sequence
acatgaacggctcgccca

SEQ ID NO: 9293 - DNA, 18 bp, Artificial sequence
  synthetic sequence
aacactcctggccaccca

SEQ ID NO: 9294 - DNA, 21 bp, Artificial sequence
  synthetic sequence
ggccaacgagatgatgccgga

SEQ ID NO: 9295 - DNA, 20 bp, Artificial sequence
  synthetic sequence
gtctccaacgacctccacca

SEQ ID NO: 9296 - DNA, 21 bp, Artificial sequence
  synthetic sequence
gcacaaccaaggactactgca

SEQ ID NO: 9297 - DNA, 21 bp, Artificial sequence
  synthetic sequence
catcacgcccttcctgaccaa

SEQ ID NO: 9298 - DNA, 18 bp, Artificial sequence
  synthetic sequence
agcatggtggccgcacca

SEQ ID NO: 9299 - DNA, 18 bp, Artificial sequence
  synthetic sequence
cccatgggcggacgacca

SEQ ID NO: 9300 - DNA, 19 bp, Artificial sequence
  synthetic sequence
gcacctggacagggaggaa

SEQ ID NO: 9301 - DNA, 18 bp, Artificial sequence
  synthetic sequence
ggaccccagactccgtca

SEQ ID NO: 9302 - DNA, 18 bp, Artificial sequence
  synthetic sequence
caactggctgcaagggca

SEQ ID NO: 9303 - DNA, 20 bp, Artificial sequence
  synthetic sequence
caaactgctgagcctgccaa

SEQ ID NO: 9304 - DNA, 18 bp, Artificial sequence
  synthetic sequence
cctcccatccaagcgcaa

SEQ ID NO: 9305 - DNA, 18 bp, Artificial sequence
  synthetic sequence
ggcctatggcatcgacca

SEQ ID NO: 9306 - DNA, 22 bp, Artificial sequence
  synthetic sequence
ggtacaacgtgtcaaccaacga

SEQ ID NO: 9307 - DNA, 18 bp, Artificial sequence
  synthetic sequence
gaccgtggaaagggacca

SEQ ID NO: 9308 - DNA, 20 bp, Artificial sequence
  synthetic sequence
gaggcacaaaataccgtcga

SEQ ID NO: 9309 - DNA, 21 bp, Artificial sequence
  synthetic sequence
ctgccctcaacatagacccca

SEQ ID NO: 9310 - DNA, 19 bp, Artificial sequence
  synthetic sequence
cccttgcctgaggacagga

SEQ ID NO: 9311 - DNA, 20 bp, Artificial sequence
  synthetic sequence
gtgcaccctccccatgctga

SEQ ID NO: 9312 - DNA, 20 bp, Artificial sequence
  synthetic sequence
tgggcagcggtgaacaggaa

SEQ ID NO: 9313 - DNA, 19 bp, Artificial sequence
  synthetic sequence
ccacgcctcagactgagga

SEQ ID NO: 9314 - DNA, 18 bp, Artificial sequence
  synthetic sequence
gctgagcttcaccgagca

SEQ ID NO: 9315 - DNA, 18 bp, Artificial sequence
  synthetic sequence
aagcgagggcatgaccca

SEQ ID NO: 9316 - DNA, 19 bp, Artificial sequence
  synthetic sequence
cgtgacagggacgggcgaa

SEQ ID NO: 9317 - DNA, 18 bp, Artificial sequence
  synthetic sequence
gaccggggtcaaacgcaa

SEQ ID NO: 9318 - DNA, 20 bp, Artificial sequence
  synthetic sequence
cggtatcgtcccagacccaa

SEQ ID NO: 9319 - DNA, 19 bp, Artificial sequence
  synthetic sequence
gcagcttggcagtgaccaa

SEQ ID NO: 9320 - DNA, 20 bp, Artificial sequence
  synthetic sequence
ccatccctggactccggcca

SEQ ID NO: 9321 - DNA, 18 bp, Artificial sequence
  synthetic sequence
ggactgagattgccccca

SEQ ID NO: 9322 - DNA, 20 bp, Artificial sequence
  synthetic sequence
gatggctcagctcctgggga

SEQ ID NO: 9323 - DNA, 21 bp, Artificial sequence
  synthetic sequence
catgtgaagcagcaaggccca

SEQ ID NO: 9324 - DNA, 20 bp, Artificial sequence
  synthetic sequence
cacgttgcaatgagaggcaa

SEQ ID NO: 9325 - DNA, 22 bp, Artificial sequence
  synthetic sequence
agaagcggcctaggacagaaca

SEQ ID NO: 9326 - DNA, 20 bp, Artificial sequence
  synthetic sequence
aagtccagcctagggcagca

SEQ ID NO: 9327 - DNA, 21 bp, Artificial sequence
  synthetic sequence
gcgacctggtcacactaggca

SEQ ID NO: 9328 - DNA, 18 bp, Artificial sequence
  synthetic sequence
ccgaagactgcatcgcca

SEQ ID NO: 9329 - DNA, 21 bp, Artificial sequence
  synthetic sequence
gtatggtggatgcctgggcaa

SEQ ID NO: 9330 - DNA, 18 bp, Artificial sequence
  synthetic sequence
cggtgggtgtcaccggaa

SEQ ID NO: 9331 - DNA, 19 bp, Artificial sequence
  synthetic sequence
tgcttcagctccacggaga

SEQ ID NO: 9332 - DNA, 18 bp, Artificial sequence
  synthetic sequence
agcccagtgtgtggcaga

SEQ ID NO: 9333 - DNA, 19 bp, Artificial sequence
  synthetic sequence
tcctgctcaactccccaca

SEQ ID NO: 9334 - DNA, 20 bp, Artificial sequence
  synthetic sequence
gtgcagccctaccaagacca

SEQ ID NO: 9335 - DNA, 19 bp, Artificial sequence
  synthetic sequence
gcagcgctgtgtcaacaca

SEQ ID NO: 9336 - DNA, 18 bp, Artificial sequence
  synthetic sequence
actcgtgcccaatcccga

SEQ ID NO: 9337 - DNA, 20 bp, Artificial sequence
  synthetic sequence
cctcagagtcgaggtgccca

SEQ ID NO: 9338 - DNA, 19 bp, Artificial sequence
  synthetic sequence
ggaacaaccggccggcaga

SEQ ID NO: 9339 - DNA, 20 bp, Artificial sequence
  synthetic sequence
cagcatctgtgcccagagca

SEQ ID NO: 9340 - DNA, 21 bp, Artificial sequence
  synthetic sequence
gacccgtgagacaaagaagca

SEQ ID NO: 9341 - DNA, 20 bp, Artificial sequence
  synthetic sequence
ggccctctcagactccgaga

SEQ ID NO: 9342 - DNA, 18 bp, Artificial sequence
  synthetic sequence
aggaggaatggagcccca

SEQ ID NO: 9343 - DNA, 21 bp, Artificial sequence
  synthetic sequence
ccggggcttcaccaagaccta

SEQ ID NO: 9344 - DNA, 22 bp, Artificial sequence
  synthetic sequence
ccatgaggcactgggaaaagca

SEQ ID NO: 9345 - DNA, 19 bp, Artificial sequence
  synthetic sequence
tcggatgcctcagtgcaga

SEQ ID NO: 9346 - DNA, 18 bp, Artificial sequence
  synthetic sequence
gctggaacccattccgca

SEQ ID NO: 9347 - DNA, 18 bp, Artificial sequence
  synthetic sequence
gcagcaagcactggccaa

SEQ ID NO: 9348 - DNA, 19 bp, Artificial sequence
  synthetic sequence
cacaggccaggaatggaga

SEQ ID NO: 9349 - DNA, 20 bp, Artificial sequence
  synthetic sequence
tggatcaaggaccagaggca

SEQ ID NO: 9350 - DNA, 20 bp, Artificial sequence
  synthetic sequence
cgtcaccatcggtgccacca

SEQ ID NO: 9351 - DNA, 22 bp, Artificial sequence
  synthetic sequence
tggcagactgggtgtacaacga

SEQ ID NO: 9352 - DNA, 21 bp, Artificial sequence
  synthetic sequence
cgaggacctcaaagtgggaca

SEQ ID NO: 9353 - DNA, 18 bp, Artificial sequence
  synthetic sequence
ctgcacggtgcgggacca

SEQ ID NO: 9354 - DNA, 18 bp, Artificial sequence
  synthetic sequence
ccggcagattggaggcga

SEQ ID NO: 9355 - DNA, 22 bp, Artificial sequence
  synthetic sequence
gaaatctgtcaggtcagcccaa

SEQ ID NO: 9356 - DNA, 20 bp, Artificial sequence
  synthetic sequence
tccatcgaacccatccgcga

SEQ ID NO: 9357 - DNA, 18 bp, Artificial sequence
  synthetic sequence
gaaggaccccgacggcaa

SEQ ID NO: 9358 - DNA, 18 bp, Artificial sequence
  synthetic sequence
gggtgcaggctgctcgca

SEQ ID NO: 9359 - DNA, 20 bp, Artificial sequence
  synthetic sequence
aagcagcgggaggagtacca

SEQ ID NO: 9360 - DNA, 20 bp, Artificial sequence
  synthetic sequence
cggcggcaaaggcaagagca

SEQ ID NO: 9361 - DNA, 19 bp, Artificial sequence
  synthetic sequence
ccgccctacctcacaagca

SEQ ID NO: 9362 - DNA, 20 bp, Artificial sequence
  synthetic sequence
cctgtgagagtgggggagga

SEQ ID NO: 9363 - DNA, 20 bp, Artificial sequence
  synthetic sequence
cctaccccatcccacagcca

SEQ ID NO: 9364 - DNA, 21 bp, Artificial sequence
  synthetic sequence
cctgaggctgcagcagaagca

SEQ ID NO: 9365 - DNA, 18 bp, Artificial sequence
  synthetic sequence
atcgaccaggatgggcca

SEQ ID NO: 9366 - DNA, 20 bp, Artificial sequence
  synthetic sequence
aaacttggcaagatgcacca

SEQ ID NO: 9367 - DNA, 22 bp, Artificial sequence
  synthetic sequence
gcaacactggactgtcaaccca

SEQ ID NO: 9368 - DNA, 21 bp, Artificial sequence
  synthetic sequence
cctccgtctacgcctacacca

SEQ ID NO: 9369 - DNA, 19 bp, Artificial sequence
  synthetic sequence
gcgagtgcaggtacgagga

SEQ ID NO: 9370 - DNA, 20 bp, Artificial sequence
  synthetic sequence
cagggacggctctcctggca

SEQ ID NO: 9371 - DNA, 20 bp, Artificial sequence
  synthetic sequence
gggagtcaggaccctctcca

SEQ ID NO: 9372 - DNA, 18 bp, Artificial sequence
  synthetic sequence
ctgcggctctgcgccaca

SEQ ID NO: 9373 - DNA, 21 bp, Artificial sequence
  synthetic sequence
ttgcaggatgcggaggaggaa

SEQ ID NO: 9374 - DNA, 20 bp, Artificial sequence
  synthetic sequence
aggggtacagtgggacagca

SEQ ID NO: 9375 - DNA, 25 bp, Artificial sequence
  synthetic sequence
aatagcatgtgacacaggacagcca

SEQ ID NO: 9376 - DNA, 20 bp, Artificial sequence
  synthetic sequence
cacagcttcaagggggagga

SEQ ID NO: 9377 - DNA, 18 bp, Artificial sequence
  synthetic sequence
ctgcacaggctgccggaa

SEQ ID NO: 9378 - DNA, 21 bp, Artificial sequence
  synthetic sequence
agaaagtgggagcagaagaca

SEQ ID NO: 9379 - DNA, 20 bp, Artificial sequence
  synthetic sequence
acgatgccgcaggagagaga

SEQ ID NO: 9380 - DNA, 18 bp, Artificial sequence
  synthetic sequence
agcccctggacaaggtca

SEQ ID NO: 9381 - DNA, 21 bp, Artificial sequence
  synthetic sequence
tgcaaggaggacgagtaccca

SEQ ID NO: 9382 - DNA, 20 bp, Artificial sequence
  synthetic sequence
ctgcatcaagagcaaaccga

SEQ ID NO: 9383 - DNA, 21 bp, Artificial sequence
  synthetic sequence
caggagggagagagagacaca

SEQ ID NO: 9384 - DNA, 20 bp, Artificial sequence
  synthetic sequence
aagagggggagcttgaagga

SEQ ID NO: 9385 - DNA, 18 bp, Artificial sequence
  synthetic sequence
agaagtccagcacgccca

SEQ ID NO: 9386 - DNA, 18 bp, Artificial sequence
  synthetic sequence
ccttggacagcgcccaca

SEQ ID NO: 9387 - DNA, 19 bp, Artificial sequence
  synthetic sequence
gcccagaacctcacaggga

SEQ ID NO: 9388 - DNA, 20 bp, Artificial sequence
  synthetic sequence
ctgcatcacccacagccgca

SEQ ID NO: 9389 - DNA, 18 bp, Artificial sequence
  synthetic sequence
tgggacgaaggagaggga

SEQ ID NO: 9390 - DNA, 18 bp, Artificial sequence
  synthetic sequence
gacccagcctgggacaga

SEQ ID NO: 9391 - DNA, 20 bp, Artificial sequence
  synthetic sequence
cagaggtgatgtggcaacca

SEQ ID NO: 9392 - DNA, 18 bp, Artificial sequence
  synthetic sequence
accccgctaccccgagga

SEQ ID NO: 9393 - DNA, 21 bp, Artificial sequence
  synthetic sequence
ggccaagtggctcccaatgca

SEQ ID NO: 9394 - DNA, 18 bp, Artificial sequence
  synthetic sequence
gcagcccacctggacaga

SEQ ID NO: 9395 - DNA, 18 bp, Artificial sequence
  synthetic sequence
gcaatgaggccctgcaca

SEQ ID NO: 9396 - DNA, 20 bp, Artificial sequence
  synthetic sequence
acagaggtagtgcagggcaa

SEQ ID NO: 9397 - DNA, 18 bp, Artificial sequence
  synthetic sequence
tggcgcctacacgggaga

SEQ ID NO: 9398 - DNA, 20 bp, Artificial sequence
  synthetic sequence
ccaagctccacccaagtcaa

SEQ ID NO: 9399 - DNA, 18 bp, Artificial sequence
  synthetic sequence
gccagggacccaggagga

SEQ ID NO: 9400 - DNA, 21 bp, Artificial sequence
  synthetic sequence
caggtcaccaagatgctggca

SEQ ID NO: 9401 - DNA, 20 bp, Artificial sequence
  synthetic sequence
tgcccccaacatggccagaa

SEQ ID NO: 9402 - DNA, 21 bp, Artificial sequence
  synthetic sequence
actgggcttcatgggagcaga

SEQ ID NO: 9403 - DNA, 21 bp, Artificial sequence
  synthetic sequence
gcccagtacgcagactctgaa

SEQ ID NO: 9404 - DNA, 21 bp, Artificial sequence
  synthetic sequence
tgaggacttacacggacgcta

SEQ ID NO: 9405 - DNA, 21 bp, Artificial sequence
  synthetic sequence
gtggcgacaggtatcctagga

SEQ ID NO: 9406 - DNA, 18 bp, Artificial sequence
  synthetic sequence
cggctcacagtcccccga

SEQ ID NO: 9407 - DNA, 19 bp, Artificial sequence
  synthetic sequence
cccgcacacctggcagcaa

SEQ ID NO: 9408 - DNA, 20 bp, Artificial sequence
  synthetic sequence
tgaggagtatcccgaccgca

SEQ ID NO: 9409 - DNA, 18 bp, Artificial sequence
  synthetic sequence
ggcagcagaagaggccaa

SEQ ID NO: 9410 - DNA, 18 bp, Artificial sequence
  synthetic sequence
aatggaacgcccgaggga

SEQ ID NO: 9411 - DNA, 18 bp, Artificial sequence
  synthetic sequence
gcatgctggcagaggaca

SEQ ID NO: 9412 - DNA, 18 bp, Artificial sequence
  synthetic sequence
gcaccgaggatgggccaa

SEQ ID NO: 9413 - DNA, 22 bp, Artificial sequence
  synthetic sequence
accagagtacaggcaaaaggca

SEQ ID NO: 9414 - DNA, 22 bp, Artificial sequence
  synthetic sequence
cagctggagaattacacaccca

SEQ ID NO: 9415 - DNA, 19 bp, Artificial sequence
  synthetic sequence
ctgagagaggtggggcaga

SEQ ID NO: 9416 - DNA, 18 bp, Artificial sequence
  synthetic sequence
ccaggacagatgcccaca

SEQ ID NO: 9417 - DNA, 20 bp, Artificial sequence
  synthetic sequence
ccacaacctgcgcctatcca

SEQ ID NO: 9418 - DNA, 21 bp, Artificial sequence
  synthetic sequence
tcccactgtccatccgccaga

SEQ ID NO: 9419 - DNA, 21 bp, Artificial sequence
  synthetic sequence
cagcctgtgaacatcaaggca

SEQ ID NO: 9420 - DNA, 20 bp, Artificial sequence
  synthetic sequence
ctccagaggaacaagggcaa

SEQ ID NO: 9421 - DNA, 19 bp, Artificial sequence
  synthetic sequence
gcagcagcgttcagaccaa

SEQ ID NO: 9422 - DNA, 20 bp, Artificial sequence
  synthetic sequence
cagtgaaggaagctcccgga

SEQ ID NO: 9423 - DNA, 19 bp, Artificial sequence
  synthetic sequence
ccagttgaaggatgcggga

SEQ ID NO: 9424 - DNA, 19 bp, Artificial sequence
  synthetic sequence
gggcacagaccactgagca

SEQ ID NO: 9425 - DNA, 19 bp, Artificial sequence
  synthetic sequence
gggtacaagcgggagcaca

SEQ ID NO: 9426 - DNA, 18 bp, Artificial sequence
  synthetic sequence
acaagacctgccccacca

SEQ ID NO: 9427 - DNA, 18 bp, Artificial sequence
  synthetic sequence
gaaccccaaataccggca

SEQ ID NO: 9428 - DNA, 22 bp, Artificial sequence
  synthetic sequence
aatgtacccaaggagcctgaga

SEQ ID NO: 9429 - DNA, 21 bp, Artificial sequence
  synthetic sequence
ccgtgtcaagacccccacaga

SEQ ID NO: 9430 - DNA, 18 bp, Artificial sequence
  synthetic sequence
ccagctgtcggatggcaa

SEQ ID NO: 9431 - DNA, 18 bp, Artificial sequence
  synthetic sequence
cgaggccaaagtcaggca

SEQ ID NO: 9432 - DNA, 20 bp, Artificial sequence
  synthetic sequence
cagagctcggcagaaaacga

SEQ ID NO: 9433 - DNA, 21 bp, Artificial sequence
  synthetic sequence
ctcccagaaaaggcggaagga

SEQ ID NO: 9434 - DNA, 18 bp, Artificial sequence
  synthetic sequence
ctgccacctgtgaaccca

SEQ ID NO: 9435 - DNA, 18 bp, Artificial sequence
  synthetic sequence
actgcagctcagccccaa

SEQ ID NO: 9436 - DNA, 18 bp, Artificial sequence
  synthetic sequence
cgggacacaagacaggca

SEQ ID NO: 9437 - DNA, 18 bp, Artificial sequence
  synthetic sequence
acaagacgtcggagggca

SEQ ID NO: 9438 - DNA, 18 bp, Artificial sequence
  synthetic sequence
acaagacctcggagggca

SEQ ID NO: 9439 - DNA, 18 bp, Artificial sequence
  synthetic sequence
aggggccctcctcgccaa

SEQ ID NO: 9440 - DNA, 21 bp, Artificial sequence
  synthetic sequence
gcaacgggaagctgagaggca

SEQ ID NO: 9441 - DNA, 18 bp, Artificial sequence
  synthetic sequence
agaccacgtctgtgcgga

SEQ ID NO: 9442 - DNA, 19 bp, Artificial sequence
  synthetic sequence
cgccagctctggctacgaa

SEQ ID NO: 9443 - DNA, 20 bp, Artificial sequence
  synthetic sequence
cggaagagcttcagccacca

SEQ ID NO: 9444 - DNA, 25 bp, Artificial sequence
  synthetic sequence
ctggtccaacaaccaacaacatgga

SEQ ID NO: 9445 - DNA, 20 bp, Artificial sequence
  synthetic sequence
aaggtgagccggtccgagac

SEQ ID NO: 9446 - DNA, 19 bp, Artificial sequence
  synthetic sequence
agacggtccctctcccgac

SEQ ID NO: 9447 - DNA, 21 bp, Artificial sequence
  synthetic sequence
acacgcactcggtccgattcg

SEQ ID NO: 9448 - DNA, 20 bp, Artificial sequence
  synthetic sequence
acgggaagactaagtccgtc

SEQ ID NO: 9449 - DNA, 18 bp, Artificial sequence
  synthetic sequence
acggcgaccacgttagag

SEQ ID NO: 9450 - DNA, 19 bp, Artificial sequence
  synthetic sequence
aggaatcccagaccgaccc

SEQ ID NO: 9451 - DNA, 18 bp, Artificial sequence
  synthetic sequence
aggaccacgacgcgtaga

SEQ ID NO: 9452 - DNA, 21 bp, Artificial sequence
  synthetic sequence
aacgacgccttcctaccacta

SEQ ID NO: 9453 - DNA, 22 bp, Artificial sequence
  synthetic sequence
aagacacagacggagacagccg

SEQ ID NO: 9454 - DNA, 18 bp, Artificial sequence
  synthetic sequence
agacggcgcagcattagg

SEQ ID NO: 9455 - DNA, 19 bp, Artificial sequence
  synthetic sequence
aggacaaggagcccacacg

SEQ ID NO: 9456 - DNA, 18 bp, Artificial sequence
  synthetic sequence
aagggacctcggagtcct

SEQ ID NO: 9457 - DNA, 19 bp, Artificial sequence
  synthetic sequence
aggagggggtcaagtgggg

SEQ ID NO: 9458 - DNA, 18 bp, Artificial sequence
  synthetic sequence
aaccgaccggccaacttg

SEQ ID NO: 9459 - DNA, 18 bp, Artificial sequence
  synthetic sequence
aacccggcttgaaagacc

SEQ ID NO: 9460 - DNA, 19 bp, Artificial sequence
  synthetic sequence
agtgtgtggagggaggacc

SEQ ID NO: 9461 - DNA, 19 bp, Artificial sequence
  synthetic sequence
acggcaacatcatccgggc

SEQ ID NO: 9462 - DNA, 18 bp, Artificial sequence
  synthetic sequence
agccccaacgagtaggga

SEQ ID NO: 9463 - DNA, 18 bp, Artificial sequence
  synthetic sequence
aacgcccgaacccgttac

SEQ ID NO: 9464 - DNA, 18 bp, Artificial sequence
  synthetic sequence
agcacactactccacggg

SEQ ID NO: 9465 - DNA, 22 bp, Artificial sequence
  synthetic sequence
aaccgtataacccaacaccgtc

SEQ ID NO: 9466 - DNA, 20 bp, Artificial sequence
  synthetic sequence
aggtctcgacgggggcctac

SEQ ID NO: 9467 - DNA, 18 bp, Artificial sequence
  synthetic sequence
acccacgacaccaggtgc

SEQ ID NO: 9468 - DNA, 20 bp, Artificial sequence
  synthetic sequence
agccagtcgagaacaacgtc

SEQ ID NO: 9469 - DNA, 18 bp, Artificial sequence
  synthetic sequence
accagtaagagggtcggt

SEQ ID NO: 9470 - DNA, 18 bp, Artificial sequence
  synthetic sequence
aagcaggaacctcccagc

SEQ ID NO: 9471 - DNA, 18 bp, Artificial sequence
  synthetic sequence
acggcaaaaggacccgac

SEQ ID NO: 9472 - DNA, 22 bp, Artificial sequence
  synthetic sequence
acccgagtcaatctcaggctat

SEQ ID NO: 9473 - DNA, 18 bp, Artificial sequence
  synthetic sequence
aggggcctcggcggagag

SEQ ID NO: 9474 - DNA, 18 bp, Artificial sequence
  synthetic sequence
accagtcccgtcacccga

SEQ ID NO: 9475 - DNA, 21 bp, Artificial sequence
  synthetic sequence
agagagttacccgacctgaga

SEQ ID NO: 9476 - DNA, 20 bp, Artificial sequence
  synthetic sequence
agagatggacgaggccacgg

SEQ ID NO: 9477 - DNA, 20 bp, Artificial sequence
  synthetic sequence
acgaagcacgatccctgcaa

SEQ ID NO: 9478 - DNA, 18 bp, Artificial sequence
  synthetic sequence
agggcaggcgcaaggtcg

SEQ ID NO: 9479 - DNA, 18 bp, Artificial sequence
  synthetic sequence
acgccatgaccggcaaca

SEQ ID NO: 9480 - DNA, 18 bp, Artificial sequence
  synthetic sequence
agagggtgcaccactacc

SEQ ID NO: 9481 - DNA, 20 bp, Artificial sequence
  synthetic sequence
aactcgacccgtgtccgacg

SEQ ID NO: 9482 - DNA, 20 bp, Artificial sequence
  synthetic sequence
aggagaaaacagccggatcc

SEQ ID NO: 9483 - DNA, 18 bp, Artificial sequence
  synthetic sequence
acgggtccacaccaggag

SEQ ID NO: 9484 - DNA, 21 bp, Artificial sequence
  synthetic sequence
agcactcgcactcatctccgg

SEQ ID NO: 9485 - DNA, 18 bp, Artificial sequence
  synthetic sequence
agaggtccaccctcccca

SEQ ID NO: 9486 - DNA, 20 bp, Artificial sequence
  synthetic sequence
agcaggtacacacacgtcat

SEQ ID NO: 9487 - DNA, 20 bp, Artificial sequence
  synthetic sequence
aggaggacacccgagtacca

SEQ ID NO: 9488 - DNA, 18 bp, Artificial sequence
  synthetic sequence
acgactcgctacaggacg

SEQ ID NO: 9489 - DNA, 19 bp, Artificial sequence
  synthetic sequence
agcgccagagacgtgatcg

SEQ ID NO: 9490 - DNA, 18 bp, Artificial sequence
  synthetic sequence
accccgaagggctaccga

SEQ ID NO: 9491 - DNA, 18 bp, Artificial sequence
  synthetic sequence
accagtcccggtaagacc

SEQ ID NO: 9492 - DNA, 18 bp, Artificial sequence
  synthetic sequence
acacgtcggcatccacgg

SEQ ID NO: 9493 - DNA, 20 bp, Artificial sequence
  synthetic sequence
acagagggagggagtggtgt

SEQ ID NO: 9494 - DNA, 21 bp, Artificial sequence
  synthetic sequence
acccaaaggtgtgagtcggtc

SEQ ID NO: 9495 - DNA, 22 bp, Artificial sequence
  synthetic sequence
aggaaaccgttgaatccgagaa

SEQ ID NO: 9496 - DNA, 20 bp, Artificial sequence
  synthetic sequence
agacccacctaggttcacgg

SEQ ID NO: 9497 - DNA, 22 bp, Artificial sequence
  synthetic sequence
agcgagacagaaatgggtaaga

SEQ ID NO: 9498 - DNA, 20 bp, Artificial sequence
  synthetic sequence
aggagtccaaagagacgcag

SEQ ID NO: 9499 - DNA, 21 bp, Artificial sequence
  synthetic sequence
agccagtcacagcttgacaaa

SEQ ID NO: 9500 - DNA, 18 bp, Artificial sequence
  synthetic sequence
aacgtaggtcggaaaggt

SEQ ID NO: 9501 - DNA, 18 bp, Artificial sequence
  synthetic sequence
agtggaaggtgtgcggca

SEQ ID NO: 9502 - DNA, 18 bp, Artificial sequence
  synthetic sequence
accaccacaaccgacgac

SEQ ID NO: 9503 - DNA, 20 bp, Artificial sequence
  synthetic sequence
acacgagaggaacccaggag

SEQ ID NO: 9504 - DNA, 20 bp, Artificial sequence
  synthetic sequence
aactgcccgtcacggagtcg

SEQ ID NO: 9505 - DNA, 20 bp, Artificial sequence
  synthetic sequence
accctgcaactcacgtagac

SEQ ID NO: 9506 - DNA, 19 bp, Artificial sequence
  synthetic sequence
agggccgggtgtaaccagg

SEQ ID NO: 9507 - DNA, 18 bp, Artificial sequence
  synthetic sequence
agaccgactcgctcggga

SEQ ID NO: 9508 - DNA, 18 bp, Artificial sequence
  synthetic sequence
acagaaggtacaaccgcg

SEQ ID NO: 9509 - DNA, 22 bp, Artificial sequence
  synthetic sequence
acctccaaagaccaaaccagag

SEQ ID NO: 9510 - DNA, 18 bp, Artificial sequence
  synthetic sequence
acgcacatccgctagtgg

SEQ ID NO: 9511 - DNA, 18 bp, Artificial sequence
  synthetic sequence
agcgcgcgtcggtcatct

SEQ ID NO: 9512 - DNA, 19 bp, Artificial sequence
  synthetic sequence
aagtggcgagagcaaccat

SEQ ID NO: 9513 - DNA, 18 bp, Artificial sequence
  synthetic sequence
agtggcccaagtacgtcg

SEQ ID NO: 9514 - DNA, 22 bp, Artificial sequence
  synthetic sequence
acgacgttccaggactactagt

SEQ ID NO: 9515 - DNA, 20 bp, Artificial sequence
  synthetic sequence
aaggaccctctctgcgtttg

SEQ ID NO: 9516 - DNA, 21 bp, Artificial sequence
  synthetic sequence
accgctacatggccaggtacg

SEQ ID NO: 9517 - DNA, 18 bp, Artificial sequence
  synthetic sequence
aaccggtggcagacccgg

SEQ ID NO: 9518 - DNA, 20 bp, Artificial sequence
  synthetic sequence
aacgccgactgccgagtagt

SEQ ID NO: 9519 - DNA, 19 bp, Artificial sequence
  synthetic sequence
accaaccttccgaacctcg

SEQ ID NO: 9520 - DNA, 18 bp, Artificial sequence
  synthetic sequence
aaggacacaacgcgtcgc

SEQ ID NO: 9521 - DNA, 20 bp, Artificial sequence
  synthetic sequence
aggtgagtgacagagcggtc

SEQ ID NO: 9522 - DNA, 21 bp, Artificial sequence
  synthetic sequence
agggcagtgacacatcaaggg

SEQ ID NO: 9523 - DNA, 20 bp, Artificial sequence
  synthetic sequence
accggtcagagaagagggta

SEQ ID NO: 9524 - DNA, 18 bp, Artificial sequence
  synthetic sequence
agcagtgcaagcccacga

SEQ ID NO: 9525 - DNA, 19 bp, Artificial sequence
  synthetic sequence
accccgtccagtaagcccc

SEQ ID NO: 9526 - DNA, 20 bp, Artificial sequence
  synthetic sequence
acagtccgacaacaccgaat

SEQ ID NO: 9527 - DNA, 18 bp, Artificial sequence
  synthetic sequence
accagtccaacggtgcca

SEQ ID NO: 9528 - DNA, 18 bp, Artificial sequence
  synthetic sequence
agcccgaagtgaacggcg

SEQ ID NO: 9529 - DNA, 20 bp, Artificial sequence
  synthetic sequence
acgatacgggacctagagtt

SEQ ID NO: 9530 - DNA, 19 bp, Artificial sequence
  synthetic sequence
acgggtcaacgaggacaag

SEQ ID NO: 9531 - DNA, 18 bp, Artificial sequence
  synthetic sequence
acaggggaccgactcacg

SEQ ID NO: 9532 - DNA, 20 bp, Artificial sequence
  synthetic sequence
agagggagacgactgaaggg

SEQ ID NO: 9533 - DNA, 21 bp, Artificial sequence
  synthetic sequence
acgactgaaacaagggacgac

SEQ ID NO: 9534 - DNA, 21 bp, Artificial sequence
  synthetic sequence
accagggtaaacccactctgt

SEQ ID NO: 9535 - DNA, 20 bp, Artificial sequence
  synthetic sequence
acacgtccttccgaccggag

SEQ ID NO: 9536 - DNA, 21 bp, Artificial sequence
  synthetic sequence
aggacgagtgagagactccag

SEQ ID NO: 9537 - DNA, 18 bp, Artificial sequence
  synthetic sequence
agcacggtcaaggcgacc

SEQ ID NO: 9538 - DNA, 18 bp, Artificial sequence
  synthetic sequence
aaccgcagcgagagtgtc

SEQ ID NO: 9539 - DNA, 18 bp, Artificial sequence
  synthetic sequence
aggacgacccagggctag

SEQ ID NO: 9540 - DNA, 17 bp, Artificial sequence
  synthetic sequence
acgagacgggtacaggg

SEQ ID NO: 9541 - DNA, 21 bp, Artificial sequence
  synthetic sequence
aggacctaggtctgaaggacc

SEQ ID NO: 9542 - DNA, 21 bp, Artificial sequence
  synthetic sequence
agacgcgaggacgacttgaag

SEQ ID NO: 9543 - DNA, 18 bp, Artificial sequence
  synthetic sequence
aaccccaccggtcaccca

SEQ ID NO: 9544 - DNA, 21 bp, Artificial sequence
  synthetic sequence
aagcgaacatcagccgtggtg

SEQ ID NO: 9545 - DNA, 18 bp, Artificial sequence
  synthetic sequence
acgagcaaccggtagacg

SEQ ID NO: 9546 - DNA, 17 bp, Artificial sequence
  synthetic sequence
acccgctgacgaagtgg

SEQ ID NO: 9547 - DNA, 20 bp, Artificial sequence
  synthetic sequence
aggggccacgactccaaagc

SEQ ID NO: 9548 - DNA, 18 bp, Artificial sequence
  synthetic sequence
agggccgacgaaagacga

SEQ ID NO: 9549 - DNA, 20 bp, Artificial sequence
  synthetic sequence
agtggacagaactacacgtc

SEQ ID NO: 9550 - DNA, 18 bp, Artificial sequence
  synthetic sequence
agggaggaggaccgcaga

SEQ ID NO: 9551 - DNA, 18 bp, Artificial sequence
  synthetic sequence
aggcgtgtcgacctccag

SEQ ID NO: 9552 - DNA, 18 bp, Artificial sequence
  synthetic sequence
aggagtcgcaggacccaa

SEQ ID NO: 9553 - DNA, 18 bp, Artificial sequence
  synthetic sequence
agcaaccagcggctgttc

SEQ ID NO: 9554 - DNA, 18 bp, Artificial sequence
  synthetic sequence
acagggcgacctggacac

SEQ ID NO: 9555 - DNA, 18 bp, Artificial sequence
  synthetic sequence
acgcaaaagggtccaggt

SEQ ID NO: 9556 - DNA, 20 bp, Artificial sequence
  synthetic sequence
aggagcacagtgtccgaacc

SEQ ID NO: 9557 - DNA, 18 bp, Artificial sequence
  synthetic sequence
agggagctcccaggaacc

SEQ ID NO: 9558 - DNA, 20 bp, Artificial sequence
  synthetic sequence
acagggctcagtgagtcgtc

SEQ ID NO: 9559 - DNA, 19 bp, Artificial sequence
  synthetic sequence
accagagtgtcgaacaggt

SEQ ID NO: 9560 - DNA, 21 bp, Artificial sequence
  synthetic sequence
acacccataaacgtcgagact

SEQ ID NO: 9561 - DNA, 20 bp, Artificial sequence
  synthetic sequence
aacccgtccagacactgact

SEQ ID NO: 9562 - DNA, 18 bp, Artificial sequence
  synthetic sequence
aacccccgaatggcgagg

SEQ ID NO: 9563 - DNA, 21 bp, Artificial sequence
  synthetic sequence
atcgactcgactaggcgtcgt

SEQ ID NO: 9564 - DNA, 23 bp, Artificial sequence
  synthetic sequence
acatccacgacaacaggagaaag

SEQ ID NO: 9565 - DNA, 20 bp, Artificial sequence
  synthetic sequence
acggaagtgtctacgacgac

SEQ ID NO: 9566 - DNA, 20 bp, Artificial sequence
  synthetic sequence
accgaccacagcaaaacagg

SEQ ID NO: 9567 - DNA, 18 bp, Artificial sequence
  synthetic sequence
acctacctcagggtgcga

SEQ ID NO: 9568 - DNA, 19 bp, Artificial sequence
  synthetic sequence
agagggcctaatcccgtac

SEQ ID NO: 9569 - DNA, 18 bp, Artificial sequence
  synthetic sequence
agcagcccggccggagac

SEQ ID NO: 9570 - DNA, 18 bp, Artificial sequence
  synthetic sequence
aagggagttcgcccaaca

SEQ ID NO: 9571 - DNA, 19 bp, Artificial sequence
  synthetic sequence
aggaaggaggttcccaccg

SEQ ID NO: 9572 - DNA, 19 bp, Artificial sequence
  synthetic sequence
acctagcggaagagcaact

SEQ ID NO: 9573 - DNA, 18 bp, Artificial sequence
  synthetic sequence
acacgacgcacccccttc

SEQ ID NO: 9574 - DNA, 19 bp, Artificial sequence
  synthetic sequence
accgacagactaccgtaac

SEQ ID NO: 9575 - DNA, 19 bp, Artificial sequence
  synthetic sequence
aacaggaccctgggactct

SEQ ID NO: 9576 - DNA, 20 bp, Artificial sequence
  synthetic sequence
acaggtcgagaccaggtacg

SEQ ID NO: 9577 - DNA, 18 bp, Artificial sequence
  synthetic sequence
aagcagacgacctcgacg

SEQ ID NO: 9578 - DNA, 18 bp, Artificial sequence
  synthetic sequence
acgtgaacgagaggcccc

SEQ ID NO: 9579 - DNA, 20 bp, Artificial sequence
  synthetic sequence
acgaccatactgagcaacgg

SEQ ID NO: 9580 - DNA, 18 bp, Artificial sequence
  synthetic sequence
acgacccctaagagcagg

SEQ ID NO: 9581 - DNA, 18 bp, Artificial sequence
  synthetic sequence
acgctcaaacacggtcga

SEQ ID NO: 9582 - DNA, 21 bp, Artificial sequence
  synthetic sequence
acgacatcccggaccagtatc

SEQ ID NO: 9583 - DNA, 18 bp, Artificial sequence
  synthetic sequence
acgggtccaagaggacgt

SEQ ID NO: 9584 - DNA, 19 bp, Artificial sequence
  synthetic sequence
atcccggaaagtaaccccc

SEQ ID NO: 9585 - DNA, 19 bp, Artificial sequence
  synthetic sequence
agacccgacatgtgcacat

SEQ ID NO: 9586 - DNA, 18 bp, Artificial sequence
  synthetic sequence
aacgctccggcgaagaag

SEQ ID NO: 9587 - DNA, 19 bp, Artificial sequence
  synthetic sequence
atcgggagcaagagagccg

SEQ ID NO: 9588 - DNA, 20 bp, Artificial sequence
  synthetic sequence
aagggaagggcttccagtcg

SEQ ID NO: 9589 - DNA, 20 bp, Artificial sequence
  synthetic sequence
acctaccgaaagtcgcaaag

SEQ ID NO: 9590 - DNA, 18 bp, Artificial sequence
  synthetic sequence
accgcactacctacgacc

SEQ ID NO: 9591 - DNA, 18 bp, Artificial sequence
  synthetic sequence
acgagaccgacacgacca

SEQ ID NO: 9592 - DNA, 18 bp, Artificial sequence
  synthetic sequence
agccggagaaggggaaga

SEQ ID NO: 9593 - DNA, 20 bp, Artificial sequence
  synthetic sequence
agcaccccgacgtcaatctc

SEQ ID NO: 9594 - DNA, 18 bp, Artificial sequence
  synthetic sequence
accccataacccccgtag

SEQ ID NO: 9595 - DNA, 20 bp, Artificial sequence
  synthetic sequence
accagtcacacggacacgac

SEQ ID NO: 9596 - DNA, 20 bp, Artificial sequence
  synthetic sequence
acgagtccggccgcaagtct

SEQ ID NO: 9597 - DNA, 22 bp, Artificial sequence
  synthetic sequence
aagcagtacccaccaaagggac

SEQ ID NO: 9598 - DNA, 20 bp, Artificial sequence
  synthetic sequence
agacgatccgaccaggcttc

SEQ ID NO: 9599 - DNA, 21 bp, Artificial sequence
  synthetic sequence
agacacacggaccatctgtca

SEQ ID NO: 9600 - DNA, 20 bp, Artificial sequence
  synthetic sequence
aggactagagtcgcgaacac

SEQ ID NO: 9601 - DNA, 18 bp, Artificial sequence
  synthetic sequence
acgacgtcgaccgagttc

SEQ ID NO: 9602 - DNA, 18 bp, Artificial sequence
  synthetic sequence
accgggactagtggcagt

SEQ ID NO: 9603 - DNA, 20 bp, Artificial sequence
  synthetic sequence
agcaaggacggtgaggttgg

SEQ ID NO: 9604 - DNA, 19 bp, Artificial sequence
  synthetic sequence
agccgatacctgagcctcg

SEQ ID NO: 9605 - DNA, 18 bp, Artificial sequence
  synthetic sequence
acagcgctcgacaacctc

SEQ ID NO: 9606 - DNA, 20 bp, Artificial sequence
  synthetic sequence
aacgaacagagggtcaggtg

SEQ ID NO: 9607 - DNA, 18 bp, Artificial sequence
  synthetic sequence
acgtgaacccagacgcag

SEQ ID NO: 9608 - DNA, 18 bp, Artificial sequence
  synthetic sequence
aaggaccctgagcttggc

SEQ ID NO: 9609 - DNA, 21 bp, Artificial sequence
  synthetic sequence
aacccttgacctcgacgacga

SEQ ID NO: 9610 - DNA, 18 bp, Artificial sequence
  synthetic sequence
acgactcccaccacaacg

SEQ ID NO: 9611 - DNA, 20 bp, Artificial sequence
  synthetic sequence
acaccaggataactccggtc

SEQ ID NO: 9612 - DNA, 18 bp, Artificial sequence
  synthetic sequence
accacccccgtagacccg

SEQ ID NO: 9613 - DNA, 20 bp, Artificial sequence
  synthetic sequence
acacaggccaaggacctgtc

SEQ ID NO: 9614 - DNA, 18 bp, Artificial sequence
  synthetic sequence
aaggcgacatcggcgagt

SEQ ID NO: 9615 - DNA, 21 bp, Artificial sequence
  synthetic sequence
accgaccgacactttccgacg

SEQ ID NO: 9616 - DNA, 18 bp, Artificial sequence
  synthetic sequence
agtgaacgagtgggcgga

SEQ ID NO: 9617 - DNA, 21 bp, Artificial sequence
  synthetic sequence
acgaatctcaggaggggctag

SEQ ID NO: 9618 - DNA, 19 bp, Artificial sequence
  synthetic sequence
agaccgacccccaacatcg

SEQ ID NO: 9619 - DNA, 21 bp, Artificial sequence
  synthetic sequence
acagggccaacaggaggagga

SEQ ID NO: 9620 - DNA, 20 bp, Artificial sequence
  synthetic sequence
acgagtccaagtctcccgac

SEQ ID NO: 9621 - DNA, 18 bp, Artificial sequence
  synthetic sequence
accccgagggacaccgaa

SEQ ID NO: 9622 - DNA, 18 bp, Artificial sequence
  synthetic sequence
agggcaggaccgtcccca

SEQ ID NO: 9623 - DNA, 18 bp, Artificial sequence
  synthetic sequence
acgggcctccctatcagc

SEQ ID NO: 9624 - DNA, 18 bp, Artificial sequence
  synthetic sequence
acccgaccccacgaatac

SEQ ID NO: 9625 - DNA, 21 bp, Artificial sequence
  synthetic sequence
agtgacgagggcagtatggcc

SEQ ID NO: 9626 - DNA, 21 bp, Artificial sequence
  synthetic sequence
aacgtcacaccacctctccaa

SEQ ID NO: 9627 - DNA, 21 bp, Artificial sequence
  synthetic sequence
accacagagagggtcgaagag

SEQ ID NO: 9628 - DNA, 20 bp, Artificial sequence
  synthetic sequence
agtcgagacggtagggcgtc

SEQ ID NO: 9629 - DNA, 19 bp, Artificial sequence
  synthetic sequence
aggtcgaaagacccgtacg

SEQ ID NO: 9630 - DNA, 21 bp, Artificial sequence
  synthetic sequence
agcgactggaagacctagact

SEQ ID NO: 9631 - DNA, 20 bp, Artificial sequence
  synthetic sequence
aggttccccaacccgtcgtc

SEQ ID NO: 9632 - DNA, 21 bp, Artificial sequence
  synthetic sequence
agtcaaagagaccgcacaact

SEQ ID NO: 9633 - DNA, 21 bp, Artificial sequence
  synthetic sequence
acagaccacgacccgataggg

SEQ ID NO: 9634 - DNA, 18 bp, Artificial sequence
  synthetic sequence
accggaaccgaaaccgac

SEQ ID NO: 9635 - DNA, 20 bp, Artificial sequence
  synthetic sequence
aggtccgcggcgaagaggaa

SEQ ID NO: 9636 - DNA, 21 bp, Artificial sequence
  synthetic sequence
aggaagggtcgaagcaacgga

SEQ ID NO: 9637 - DNA, 19 bp, Artificial sequence
  synthetic sequence
agcagcggaagagcatact

SEQ ID NO: 9638 - DNA, 20 bp, Artificial sequence
  synthetic sequence
aacgtctcacagactcgggc

SEQ ID NO: 9639 - DNA, 18 bp, Artificial sequence
  synthetic sequence
accccaagtacgtcgaca

SEQ ID NO: 9640 - DNA, 18 bp, Artificial sequence
  synthetic sequence
acgaagagtcgtacgcgg

SEQ ID NO: 9641 - DNA, 21 bp, Artificial sequence
  synthetic sequence
agcaacatccctagccactgg

SEQ ID NO: 9642 - DNA, 20 bp, Artificial sequence
  synthetic sequence
acgtccagccacaagagtcc

SEQ ID NO: 9643 - DNA, 20 bp, Artificial sequence
  synthetic sequence
agaccatgacgacggctcac

SEQ ID NO: 9644 - DNA, 20 bp, Artificial sequence
  synthetic sequence
actggaccagtgactcgcat

SEQ ID NO: 9645 - DNA, 18 bp, Artificial sequence
  synthetic sequence
accacgaccagcaccaga

SEQ ID NO: 9646 - DNA, 18 bp, Artificial sequence
  synthetic sequence
aaccaacgatggtgcgcc

SEQ ID NO: 9647 - DNA, 20 bp, Artificial sequence
  synthetic sequence
acatctccacgggacagagg

SEQ ID NO: 9648 - DNA, 17 bp, Artificial sequence
  synthetic sequence
accgtgaccggccgagt

SEQ ID NO: 9649 - DNA, 20 bp, Artificial sequence
  synthetic sequence
accgacatctcgaggtccgc

SEQ ID NO: 9650 - DNA, 18 bp, Artificial sequence
  synthetic sequence
aacccggtcggagaggta

SEQ ID NO: 9651 - DNA, 18 bp, Artificial sequence
  synthetic sequence
accaggtagaaccggacg

SEQ ID NO: 9652 - DNA, 20 bp, Artificial sequence
  synthetic sequence
accgagacatccccgaagac

SEQ ID NO: 9653 - DNA, 18 bp, Artificial sequence
  synthetic sequence
aacccaaggttgcggacc

SEQ ID NO: 9654 - DNA, 18 bp, Artificial sequence
  synthetic sequence
acggcggaagaaacggtc

SEQ ID NO: 9655 - DNA, 19 bp, Artificial sequence
  synthetic sequence
acacccggtgatcctggag

SEQ ID NO: 9656 - DNA, 20 bp, Artificial sequence
  synthetic sequence
agaccatgtgcgcgacctgg

SEQ ID NO: 9657 - DNA, 18 bp, Artificial sequence
  synthetic sequence
aacggtcgacgaagcagg

SEQ ID NO: 9658 - DNA, 20 bp, Artificial sequence
  synthetic sequence
agacaatggagctccgggac

SEQ ID NO: 9659 - DNA, 19 bp, Artificial sequence
  synthetic sequence
accaagtggtcatcccggc

SEQ ID NO: 9660 - DNA, 20 bp, Artificial sequence
  synthetic sequence
agagagaggtgcaacgggtc

SEQ ID NO: 9661 - DNA, 18 bp, Artificial sequence
  synthetic sequence
acaccgggaaaaggggga

SEQ ID NO: 9662 - DNA, 18 bp, Artificial sequence
  synthetic sequence
accccgagtaagtggacc

SEQ ID NO: 9663 - DNA, 20 bp, Artificial sequence
  synthetic sequence
agcaccgacatgacgtggtg

SEQ ID NO: 9664 - DNA, 18 bp, Artificial sequence
  synthetic sequence
accaccagagtcgcgaca

SEQ ID NO: 9665 - DNA, 21 bp, Artificial sequence
  synthetic sequence
acgacctcctcgacgaagaag

SEQ ID NO: 9666 - DNA, 18 bp, Artificial sequence
  synthetic sequence
acccacgtgacccgtaag

SEQ ID NO: 9667 - DNA, 18 bp, Artificial sequence
  synthetic sequence
agagggaagagcggagct

SEQ ID NO: 9668 - DNA, 18 bp, Artificial sequence
  synthetic sequence
agcagcagcgtccgtagt

SEQ ID NO: 9669 - DNA, 18 bp, Artificial sequence
  synthetic sequence
agccggagtaaaggccgc

SEQ ID NO: 9670 - DNA, 18 bp, Artificial sequence
  synthetic sequence
acgggaccgacatccagg

SEQ ID NO: 9671 - DNA, 18 bp, Artificial sequence
  synthetic sequence
aggaagtacgacgggtcc

SEQ ID NO: 9672 - DNA, 20 bp, Artificial sequence
  synthetic sequence
agtccgaaaaactgccgaag

SEQ ID NO: 9673 - DNA, 18 bp, Artificial sequence
  synthetic sequence
aggaggtactaccgggac

SEQ ID NO: 9674 - DNA, 18 bp, Artificial sequence
  synthetic sequence
acggagggcacttcgaca

SEQ ID NO: 9675 - DNA, 18 bp, Artificial sequence
  synthetic sequence
agacccacccccagtgta

SEQ ID NO: 9676 - DNA, 19 bp, Artificial sequence
  synthetic sequence
aggagaaagaccgggtccc

SEQ ID NO: 9677 - DNA, 21 bp, Artificial sequence
  synthetic sequence
acgactgaagggtcagggtac

SEQ ID NO: 9678 - DNA, 18 bp, Artificial sequence
  synthetic sequence
aggtcgcacctctaccac

SEQ ID NO: 9679 - DNA, 20 bp, Artificial sequence
  synthetic sequence
agcagtgtccgacacgtcta

SEQ ID NO: 9680 - DNA, 20 bp, Artificial sequence
  synthetic sequence
acccacgcactccccaagac

SEQ ID NO: 9681 - DNA, 20 bp, Artificial sequence
  synthetic sequence
acaggaggtgagccatcgcc

SEQ ID NO: 9682 - DNA, 21 bp, Artificial sequence
  synthetic sequence
aaccaaaccctccgcaaccac

SEQ ID NO: 9683 - DNA, 21 bp, Artificial sequence
  synthetic sequence
aacgtcccaatgcaatccgtg

SEQ ID NO: 9684 - DNA, 18 bp, Artificial sequence
  synthetic sequence
agagggaccttgggagcg

SEQ ID NO: 9685 - DNA, 18 bp, Artificial sequence
  synthetic sequence
aggctagggaccacgagg

SEQ ID NO: 9686 - DNA, 20 bp, Artificial sequence
  synthetic sequence
agaggtcggaggacccaaag

SEQ ID NO: 9687 - DNA, 19 bp, Artificial sequence
  synthetic sequence
agacatccgtccagccgag

SEQ ID NO: 9688 - DNA, 20 bp, Artificial sequence
  synthetic sequence
accgaagtgaggtcctcgag

SEQ ID NO: 9689 - DNA, 18 bp, Artificial sequence
  synthetic sequence
acgacacccgcaagacct

SEQ ID NO: 9690 - DNA, 18 bp, Artificial sequence
  synthetic sequence
aaccactacccaccgcac

SEQ ID NO: 9691 - DNA, 20 bp, Artificial sequence
  synthetic sequence
acgggcgacctggagcatga

SEQ ID NO: 9692 - DNA, 21 bp, Artificial sequence
  synthetic sequence
agccactactacctgagcgtc

SEQ ID NO: 9693 - DNA, 20 bp, Artificial sequence
  synthetic sequence
aggaccatcggtccaagtcg

SEQ ID NO: 9694 - DNA, 20 bp, Artificial sequence
  synthetic sequence
acacaggtgttaccggagtg

SEQ ID NO: 9695 - DNA, 18 bp, Artificial sequence
  synthetic sequence
aggctactagaggggacg

SEQ ID NO: 9696 - DNA, 18 bp, Artificial sequence
  synthetic sequence
acggaacggacaacccaa

SEQ ID NO: 9697 - DNA, 20 bp, Artificial sequence
  synthetic sequence
aggccaacaagtacctcaac

SEQ ID NO: 9698 - DNA, 19 bp, Artificial sequence
  synthetic sequence
acctgcatgccgagaaacc

SEQ ID NO: 9699 - DNA, 20 bp, Artificial sequence
  synthetic sequence
aggtaagtcgaactcccagg

SEQ ID NO: 9700 - DNA, 19 bp, Artificial sequence
  synthetic sequence
aaggacttgggtacccagg

SEQ ID NO: 9701 - DNA, 18 bp, Artificial sequence
  synthetic sequence
accgctacccgggaccga

SEQ ID NO: 9702 - DNA, 20 bp, Artificial sequence
  synthetic sequence
aacccctccctgaccactcg

SEQ ID NO: 9703 - DNA, 20 bp, Artificial sequence
  synthetic sequence
accggttacttccgcatcta

SEQ ID NO: 9704 - DNA, 20 bp, Artificial sequence
  synthetic sequence
accacgtcaggagtctcgac

SEQ ID NO: 9705 - DNA, 20 bp, Artificial sequence
  synthetic sequence
agacggagtgactgcaaccg

SEQ ID NO: 9706 - DNA, 20 bp, Artificial sequence
  synthetic sequence
acgcaaagacgaaccaagag

SEQ ID NO: 9707 - DNA, 21 bp, Artificial sequence
  synthetic sequence
agtccatacgctaccggagac

SEQ ID NO: 9708 - DNA, 17 bp, Artificial sequence
  synthetic sequence
agggtcaacccggcagg

SEQ ID NO: 9709 - DNA, 19 bp, Artificial sequence
  synthetic sequence
acgacagacctgaagcccc

SEQ ID NO: 9710 - DNA, 18 bp, Artificial sequence
  synthetic sequence
acagtaccgtacaccgtc

SEQ ID NO: 9711 - DNA, 20 bp, Artificial sequence
  synthetic sequence
agtcggagccagaacgtccg

SEQ ID NO: 9712 - DNA, 19 bp, Artificial sequence
  synthetic sequence
agaccaagtccctcgtcgg

SEQ ID NO: 9713 - DNA, 18 bp, Artificial sequence
  synthetic sequence
accgaaggggtgtatccg

SEQ ID NO: 9714 - DNA, 20 bp, Artificial sequence
  synthetic sequence
agcgaacagactgtcccttg

SEQ ID NO: 9715 - DNA, 18 bp, Artificial sequence
  synthetic sequence
acaccccacgggactgta

SEQ ID NO: 9716 - DNA, 18 bp, Artificial sequence
  synthetic sequence
acacggaggacgtacctg

SEQ ID NO: 9717 - DNA, 18 bp, Artificial sequence
  synthetic sequence
actccgcacaaccggtct

SEQ ID NO: 9718 - DNA, 21 bp, Artificial sequence
  synthetic sequence
aacacccggttggacctcaaa

SEQ ID NO: 9719 - DNA, 19 bp, Artificial sequence
  synthetic sequence
aacccccatctctcgaccg

SEQ ID NO: 9720 - DNA, 18 bp, Artificial sequence
  synthetic sequence
agcacaccggtctagagc

SEQ ID NO: 9721 - DNA, 18 bp, Artificial sequence
  synthetic sequence
aggggaggtaccgtccac

SEQ ID NO: 9722 - DNA, 18 bp, Artificial sequence
  synthetic sequence
agccaggttccgaggtag

SEQ ID NO: 9723 - DNA, 18 bp, Artificial sequence
  synthetic sequence
agagctctaggcacgtcg

SEQ ID NO: 9724 - DNA, 20 bp, Artificial sequence
  synthetic sequence
agctacctacaggcgtggag

SEQ ID NO: 9725 - DNA, 20 bp, Artificial sequence
  synthetic sequence
acaggaaaggatggggggct

SEQ ID NO: 9726 - DNA, 18 bp, Artificial sequence
  synthetic sequence
acggcaccgtacaaccac

SEQ ID NO: 9727 - DNA, 18 bp, Artificial sequence
  synthetic sequence
acagaactccgcgaaccc

SEQ ID NO: 9728 - DNA, 20 bp, Artificial sequence
  synthetic sequence
aaggacgatccgttggactc

SEQ ID NO: 9729 - DNA, 18 bp, Artificial sequence
  synthetic sequence
acaggtcccacgaaggga

SEQ ID NO: 9730 - DNA, 18 bp, Artificial sequence
  synthetic sequence
accggaacaaccacgtcc

SEQ ID NO: 9731 - DNA, 19 bp, Artificial sequence
  synthetic sequence
aggaggactcggtgacgtt

SEQ ID NO: 9732 - DNA, 18 bp, Artificial sequence
  synthetic sequence
aacgaccgcttccagtcc

SEQ ID NO: 9733 - DNA, 20 bp, Artificial sequence
  synthetic sequence
aggggcatgtacaagaggga

SEQ ID NO: 9734 - DNA, 18 bp, Artificial sequence
  synthetic sequence
acgacacgaagggacgtc

SEQ ID NO: 9735 - DNA, 19 bp, Artificial sequence
  synthetic sequence
accaccggtacagaaccag

SEQ ID NO: 9736 - DNA, 19 bp, Artificial sequence
  synthetic sequence
agacaggccagaatcgcgg

SEQ ID NO: 9737 - DNA, 19 bp, Artificial sequence
  synthetic sequence
accacctcaaacctcgtcc

SEQ ID NO: 9738 - DNA, 18 bp, Artificial sequence
  synthetic sequence
aacccactcctcgcacac

SEQ ID NO: 9739 - DNA, 22 bp, Artificial sequence
  synthetic sequence
aacggtgaagagctgcgacgaa

SEQ ID NO: 9740 - DNA, 18 bp, Artificial sequence
  synthetic sequence
acgaggggagcgaagact

SEQ ID NO: 9741 - DNA, 18 bp, Artificial sequence
  synthetic sequence
acccggactcctgacact

SEQ ID NO: 9742 - DNA, 18 bp, Artificial sequence
  synthetic sequence
aggaggaccccctacccg

SEQ ID NO: 9743 - DNA, 18 bp, Artificial sequence
  synthetic sequence
accgagccgactgagtac

SEQ ID NO: 9744 - DNA, 18 bp, Artificial sequence
  synthetic sequence
aaccccgacttgaggacc

SEQ ID NO: 9745 - DNA, 19 bp, Artificial sequence
  synthetic sequence
acaggcgtcaggaatcgcc

SEQ ID NO: 9746 - DNA, 20 bp, Artificial sequence
  synthetic sequence
accgtccaagaggaagggtc

SEQ ID NO: 9747 - DNA, 18 bp, Artificial sequence
  synthetic sequence
agaggagaggacgtgggg

SEQ ID NO: 9748 - DNA, 19 bp, Artificial sequence
  synthetic sequence
agccccgacctcctcatcg

SEQ ID NO: 9749 - DNA, 20 bp, Artificial sequence
  synthetic sequence
aacccctgaccgccgaggac

SEQ ID NO: 9750 - DNA, 21 bp, Artificial sequence
  synthetic sequence
aggggagtagactcacgaaga

SEQ ID NO: 9751 - DNA, 20 bp, Artificial sequence
  synthetic sequence
agacaaccctagagccccgc

SEQ ID NO: 9752 - DNA, 18 bp, Artificial sequence
  synthetic sequence
agacagcttcccctggca

SEQ ID NO: 9753 - DNA, 18 bp, Artificial sequence
  synthetic sequence
accgagacgttggagacg

SEQ ID NO: 9754 - DNA, 19 bp, Artificial sequence
  synthetic sequence
aggaccagaactctgggcc

SEQ ID NO: 9755 - DNA, 21 bp, Artificial sequence
  synthetic sequence
aaccgctaggagaaacccaac

SEQ ID NO: 9756 - DNA, 20 bp, Artificial sequence
  synthetic sequence
aggcaataatcctcggccac

SEQ ID NO: 9757 - DNA, 21 bp, Artificial sequence
  synthetic sequence
aggagacgtaccctaccgagt

SEQ ID NO: 9758 - DNA, 19 bp, Artificial sequence
  synthetic sequence
aacgtcgttgacccgagtt

SEQ ID NO: 9759 - DNA, 18 bp, Artificial sequence
  synthetic sequence
agcgacgggacctagaac

SEQ ID NO: 9760 - DNA, 22 bp, Artificial sequence
  synthetic sequence
agagggttcaaaactcggtaag

SEQ ID NO: 9761 - DNA, 18 bp, Artificial sequence
  synthetic sequence
acgaaccaccgaaccagt

SEQ ID NO: 9762 - DNA, 18 bp, Artificial sequence
  synthetic sequence
acccccaaccgttcgtca

SEQ ID NO: 9763 - DNA, 18 bp, Artificial sequence
  synthetic sequence
agcggtaggtgacgtgtc

SEQ ID NO: 9764 - DNA, 18 bp, Artificial sequence
  synthetic sequence
aacccgacgtaccgagtg

SEQ ID NO: 9765 - DNA, 18 bp, Artificial sequence
  synthetic sequence
aaggaccgtcgacaggct

SEQ ID NO: 9766 - DNA, 19 bp, Artificial sequence
  synthetic sequence
acgacgacatgcacgagct

SEQ ID NO: 9767 - DNA, 23 bp, Artificial sequence
  synthetic sequence
acagggacatgacctggtaaaac

SEQ ID NO: 9768 - DNA, 18 bp, Artificial sequence
  synthetic sequence
accagcttgaccgggtac

SEQ ID NO: 9769 - DNA, 20 bp, Artificial sequence
  synthetic sequence
agccacatcgggtggaagtc

SEQ ID NO: 9770 - DNA, 18 bp, Artificial sequence
  synthetic sequence
acaggcagcaaatcggcg

SEQ ID NO: 9771 - DNA, 20 bp, Artificial sequence
  synthetic sequence
acgggaacatctgacacggt

SEQ ID NO: 9772 - DNA, 20 bp, Artificial sequence
  synthetic sequence
acggaagaggaggccaagta

SEQ ID NO: 9773 - DNA, 21 bp, Artificial sequence
  synthetic sequence
acacagactcgagaacccggt

SEQ ID NO: 9774 - DNA, 22 bp, Artificial sequence
  synthetic sequence
acacaaggtacaggcacccgta

SEQ ID NO: 9775 - DNA, 18 bp, Artificial sequence
  synthetic sequence
agccacgacctgcaaagg

SEQ ID NO: 9776 - DNA, 20 bp, Artificial sequence
  synthetic sequence
agaccccacgactactcaca

SEQ ID NO: 9777 - DNA, 21 bp, Artificial sequence
  synthetic sequence
acagggtcacagaagggcaca

SEQ ID NO: 9778 - DNA, 18 bp, Artificial sequence
  synthetic sequence
aagggtgacgtgccacct

SEQ ID NO: 9779 - DNA, 18 bp, Artificial sequence
  synthetic sequence
acggctagagacgtaggc

SEQ ID NO: 9780 - DNA, 18 bp, Artificial sequence
  synthetic sequence
agacggcaccggtccacg

SEQ ID NO: 9781 - DNA, 25 bp, Artificial sequence
  synthetic sequence
accgtagggaatcaaacacaggcag

SEQ ID NO: 9782 - DNA, 20 bp, Artificial sequence
  synthetic sequence
agcagccactccagtgtgag

SEQ ID NO: 9783 - DNA, 18 bp, Artificial sequence
  synthetic sequence
accgcaaacgtagggacg

SEQ ID NO: 9784 - DNA, 18 bp, Artificial sequence
  synthetic sequence
aggaccaccgtttcgggt

SEQ ID NO: 9785 - DNA, 21 bp, Artificial sequence
  synthetic sequence
actgacaaccagtcgaaggtc

SEQ ID NO: 9786 - DNA, 18 bp, Artificial sequence
  synthetic sequence
agcaagtcccttcgaccc

SEQ ID NO: 9787 - DNA, 18 bp, Artificial sequence
  synthetic sequence
aacgccacgacaacggag

SEQ ID NO: 9788 - DNA, 18 bp, Artificial sequence
  synthetic sequence
aaggggccggaagggagg

SEQ ID NO: 9789 - DNA, 18 bp, Artificial sequence
  synthetic sequence
agtgccgacggaactccc

SEQ ID NO: 9790 - DNA, 18 bp, Artificial sequence
  synthetic sequence
accggagggtgaacggtg

SEQ ID NO: 9791 - DNA, 21 bp, Artificial sequence
  synthetic sequence
acgtccggaaggttcaagact

SEQ ID NO: 9792 - DNA, 19 bp, Artificial sequence
  synthetic sequence
accgtcgccatcacctccg

SEQ ID NO: 9793 - DNA, 18 bp, Artificial sequence
  synthetic sequence
agccggagccaccttaag

SEQ ID NO: 9794 - DNA, 18 bp, Artificial sequence
  synthetic sequence
agcgacgacacgtagagg

SEQ ID NO: 9795 - DNA, 19 bp, Artificial sequence
  synthetic sequence
accacggatggtctcacgg

SEQ ID NO: 9796 - DNA, 18 bp, Artificial sequence
  synthetic sequence
accggcagtaccacatcg

SEQ ID NO: 9797 - DNA, 18 bp, Artificial sequence
  synthetic sequence
acgaccgtcgccaccaat

SEQ ID NO: 9798 - DNA, 21 bp, Artificial sequence
  synthetic sequence
agcagaaaccccgtgtcgagt

SEQ ID NO: 9799 - DNA, 18 bp, Artificial sequence
  synthetic sequence
aggacggtgccggtacgc

SEQ ID NO: 9800 - DNA, 18 bp, Artificial sequence
  synthetic sequence
accgggaggtagtggtgg

SEQ ID NO: 9801 - DNA, 18 bp, Artificial sequence
  synthetic sequence
acgggaaggtacagcagt

SEQ ID NO: 9802 - DNA, 18 bp, Artificial sequence
  synthetic sequence
acacaaggacggagcgtc

SEQ ID NO: 9803 - DNA, 20 bp, Artificial sequence
  synthetic sequence
accagtgtccgaacctactc

SEQ ID NO: 9804 - DNA, 20 bp, Artificial sequence
  synthetic sequence
accagtgtccgaacctactc

SEQ ID NO: 9805 - DNA, 20 bp, Artificial sequence
  synthetic sequence
acccgtaaccccgactacga

SEQ ID NO: 9806 - DNA, 18 bp, Artificial sequence
  synthetic sequence
agtcaggcgtacggtcga

SEQ ID NO: 9807 - DNA, 21 bp, Artificial sequence
  synthetic sequence
acctgaagatcgacgtggccc

SEQ ID NO: 9808 - DNA, 18 bp, Artificial sequence
  synthetic sequence
aggcagtgacaaccccgg

SEQ ID NO: 9809 - DNA, 20 bp, Artificial sequence
  synthetic sequence
agggaggtagtggacaggag

SEQ ID NO: 9810 - DNA, 21 bp, Artificial sequence
  synthetic sequence
aacaaccggagtgtcctcatc

SEQ ID NO: 9811 - DNA, 21 bp, Artificial sequence
  synthetic sequence
acgacctacgaggtctagacc

SEQ ID NO: 9812 - DNA, 19 bp, Artificial sequence
  synthetic sequence
accccagtctccggtgacg

SEQ ID NO: 9813 - DNA, 20 bp, Artificial sequence
  synthetic sequence
acccgtgacgagaggtggac

SEQ ID NO: 9814 - DNA, 20 bp, Artificial sequence
  synthetic sequence
agagcgacgaggaagacgaa

SEQ ID NO: 9815 - DNA, 19 bp, Artificial sequence
  synthetic sequence
aacccagtatcctcggggg

SEQ ID NO: 9816 - DNA, 18 bp, Artificial sequence
  synthetic sequence
acgaaaccgacctgctcg

SEQ ID NO: 9817 - DNA, 18 bp, Artificial sequence
  synthetic sequence
agaggggcactcgggtcc

SEQ ID NO: 9818 - DNA, 19 bp, Artificial sequence
  synthetic sequence
accccctcatgaccaggtc

SEQ ID NO: 9819 - DNA, 19 bp, Artificial sequence
  synthetic sequence
acccccacagacggcaact

SEQ ID NO: 9820 - DNA, 18 bp, Artificial sequence
  synthetic sequence
agcacacacgtcaaccgc

SEQ ID NO: 9821 - DNA, 20 bp, Artificial sequence
  synthetic sequence
accacacacatgtgggccag

SEQ ID NO: 9822 - DNA, 18 bp, Artificial sequence
  synthetic sequence
accacaaccgcggttccg

SEQ ID NO: 9823 - DNA, 24 bp, Artificial sequence
  synthetic sequence
agaggtcgacacggtaatatcaat

SEQ ID NO: 9824 - DNA, 20 bp, Artificial sequence
  synthetic sequence
aggtgtaggacggccaccag

SEQ ID NO: 9825 - DNA, 20 bp, Artificial sequence
  synthetic sequence
aaggacgacggggccaacat

SEQ ID NO: 9826 - DNA, 19 bp, Artificial sequence
  synthetic sequence
agacggtagggtcagtcct

SEQ ID NO: 9827 - DNA, 19 bp, Artificial sequence
  synthetic sequence
accaatgtccccacggtct

SEQ ID NO: 9828 - DNA, 18 bp, Artificial sequence
  synthetic sequence
aacggctacgaagacgct

SEQ ID NO: 9829 - DNA, 18 bp, Artificial sequence
  synthetic sequence
agggtgactcagggctcg

SEQ ID NO: 9830 - DNA, 18 bp, Artificial sequence
  synthetic sequence
aggaccgggtggaacaac

SEQ ID NO: 9831 - DNA, 22 bp, Artificial sequence
  synthetic sequence
aggacctgtcccgataaaggag

SEQ ID NO: 9832 - DNA, 21 bp, Artificial sequence
  synthetic sequence
acctctaccggacgtgcacct

SEQ ID NO: 9833 - DNA, 18 bp, Artificial sequence
  synthetic sequence
acaccgacgaacctcgta

SEQ ID NO: 9834 - DNA, 20 bp, Artificial sequence
  synthetic sequence
agggagccgacatcaacgac

SEQ ID NO: 9835 - DNA, 18 bp, Artificial sequence
  synthetic sequence
acccccaggggaaagtcc

SEQ ID NO: 9836 - DNA, 18 bp, Artificial sequence
  synthetic sequence
acgacggcgggggacttg

SEQ ID NO: 9837 - DNA, 18 bp, Artificial sequence
  synthetic sequence
accaacaacgggtcgctc

SEQ ID NO: 9838 - DNA, 18 bp, Artificial sequence
  synthetic sequence
acgcctaaccaccgcatc

SEQ ID NO: 9839 - DNA, 20 bp, Artificial sequence
  synthetic sequence
aagaaggtccaccgtcctac

SEQ ID NO: 9840 - DNA, 21 bp, Artificial sequence
  synthetic sequence
acgaacacctagaaccaccgt

SEQ ID NO: 9841 - DNA, 21 bp, Artificial sequence
  synthetic sequence
agagaaactcggtctgccacg

SEQ ID NO: 9842 - DNA, 21 bp, Artificial sequence
  synthetic sequence
aacggcccctgacttcacaga

SEQ ID NO: 9843 - DNA, 21 bp, Artificial sequence
  synthetic sequence
agacggagaaccacgccaggt

SEQ ID NO: 9844 - DNA, 20 bp, Artificial sequence
  synthetic sequence
agtcgaaggtcggtgaccta

SEQ ID NO: 9845 - DNA, 20 bp, Artificial sequence
  synthetic sequence
acagcgggtggtgtgggaag

SEQ ID NO: 9846 - DNA, 18 bp, Artificial sequence
  synthetic sequence
aggtccacgacgctcaag

SEQ ID NO: 9847 - DNA, 21 bp, Artificial sequence
  synthetic sequence
agagccactacatcagcccca

SEQ ID NO: 9848 - DNA, 18 bp, Artificial sequence
  synthetic sequence
accaaaagtgacgcccct

SEQ ID NO: 9849 - DNA, 18 bp, Artificial sequence
  synthetic sequence
agctgaaccctaccccca

SEQ ID NO: 9850 - DNA, 21 bp, Artificial sequence
  synthetic sequence
agaggaaaggctaactaaccg

SEQ ID NO: 9851 - DNA, 18 bp, Artificial sequence
  synthetic sequence
aacccgttccagagggct

SEQ ID NO: 9852 - DNA, 18 bp, Artificial sequence
  synthetic sequence
agccccaccagtctctcg

SEQ ID NO: 9853 - DNA, 22 bp, Artificial sequence
  synthetic sequence
agaacacacctaaggtgcagtg

SEQ ID NO: 9854 - DNA, 18 bp, Artificial sequence
  synthetic sequence
acgtacaccctcccgagt

SEQ ID NO: 9855 - DNA, 20 bp, Artificial sequence
  synthetic sequence
acggaaaatccaccaccgta

SEQ ID NO: 9856 - DNA, 18 bp, Artificial sequence
  synthetic sequence
acgaggacacggagggtc

SEQ ID NO: 9857 - DNA, 20 bp, Artificial sequence
  synthetic sequence
accccttcaggaggtcactc

SEQ ID NO: 9858 - DNA, 20 bp, Artificial sequence
  synthetic sequence
acagcttcaatggcggcggc

SEQ ID NO: 9859 - DNA, 19 bp, Artificial sequence
  synthetic sequence
aacccgtgcggacctcagg

SEQ ID NO: 9860 - DNA, 18 bp, Artificial sequence
  synthetic sequence
aaccaggctgacgctgcc

SEQ ID NO: 9861 - DNA, 18 bp, Artificial sequence
  synthetic sequence
aacccctgtccctaccga

SEQ ID NO: 9862 - DNA, 18 bp, Artificial sequence
  synthetic sequence
acgaggacctcaagggct

SEQ ID NO: 9863 - DNA, 18 bp, Artificial sequence
  synthetic sequence
acccccagtactgacacg

SEQ ID NO: 9864 - DNA, 21 bp, Artificial sequence
  synthetic sequence
aacagcactcgagacacttcg

SEQ ID NO: 9865 - DNA, 20 bp, Artificial sequence
  synthetic sequence
agagaccacaagtcccgagt

SEQ ID NO: 9866 - DNA, 18 bp, Artificial sequence
  synthetic sequence
acgaggaaccgaaggacg

SEQ ID NO: 9867 - DNA, 21 bp, Artificial sequence
  synthetic sequence
accgggttacaccgatggagg

SEQ ID NO: 9868 - DNA, 18 bp, Artificial sequence
  synthetic sequence
acgacccgtcaaagaggc

SEQ ID NO: 9869 - DNA, 18 bp, Artificial sequence
  synthetic sequence
aaccgctagagggtgagc

SEQ ID NO: 9870 - DNA, 19 bp, Artificial sequence
  synthetic sequence
acgggaacctcgtggggtg

SEQ ID NO: 9871 - DNA, 20 bp, Artificial sequence
  synthetic sequence
acgtccggcgacccgattca

SEQ ID NO: 9872 - DNA, 18 bp, Artificial sequence
  synthetic sequence
agctcccagacgtcgacc

SEQ ID NO: 9873 - DNA, 18 bp, Artificial sequence
  synthetic sequence
agaggtcgcacggacttc

SEQ ID NO: 9874 - DNA, 18 bp, Artificial sequence
  synthetic sequence
acggtcgacgacaccaac

SEQ ID NO: 9875 - DNA, 19 bp, Artificial sequence
  synthetic sequence
acgggtctaactcacggac

SEQ ID NO: 9876 - DNA, 19 bp, Artificial sequence
  synthetic sequence
accgcacacagagtgtggg

SEQ ID NO: 9877 - DNA, 22 bp, Artificial sequence
  synthetic sequence
agccggtgttcgccaacaaaat

SEQ ID NO: 9878 - DNA, 18 bp, Artificial sequence
  synthetic sequence
aggcacccttacgaggga

SEQ ID NO: 9879 - DNA, 18 bp, Artificial sequence
  synthetic sequence
agcacgggaggagccacc

SEQ ID NO: 9880 - DNA, 20 bp, Artificial sequence
  synthetic sequence
accgcatcatcatgggccgt

SEQ ID NO: 9881 - DNA, 20 bp, Artificial sequence
  synthetic sequence
agtgaccaagactcctcacc

SEQ ID NO: 9882 - DNA, 22 bp, Artificial sequence
  synthetic sequence
aaccggagtgagagaaggagta

SEQ ID NO: 9883 - DNA, 21 bp, Artificial sequence
  synthetic sequence
agcacgaacccaaaccggcgt

SEQ ID NO: 9884 - DNA, 21 bp, Artificial sequence
  synthetic sequence
accatctgaaaggccaacgtc

SEQ ID NO: 9885 - DNA, 19 bp, Artificial sequence
  synthetic sequence
acagagaaggtcgggcact

SEQ ID NO: 9886 - DNA, 18 bp, Artificial sequence
  synthetic sequence
accacgctgacaacgtcg

SEQ ID NO: 9887 - DNA, 25 bp, Artificial sequence
  synthetic sequence
aactgtcggaacggaacaaggagta

SEQ ID NO: 9888 - DNA, 19 bp, Artificial sequence
  synthetic sequence
accgaccactccagtgtcg

SEQ ID NO: 9889 - DNA, 20 bp, Artificial sequence
  synthetic sequence
acgcacacctgtcccgaaac

SEQ ID NO: 9890 - DNA, 18 bp, Artificial sequence
  synthetic sequence
acagccaacagagccgtc

SEQ ID NO: 9891 - DNA, 18 bp, Artificial sequence
  synthetic sequence
aaccggactcgacacgga

SEQ ID NO: 9892 - DNA, 22 bp, Artificial sequence
  synthetic sequence
accgacgtatacacagggcaaa

SEQ ID NO: 9893 - DNA, 21 bp, Artificial sequence
  synthetic sequence
acgtgctcagagaaggtggag

SEQ ID NO: 9894 - DNA, 22 bp, Artificial sequence
  synthetic sequence
aagcgtgaaagctagaaggacg

SEQ ID NO: 9895 - DNA, 20 bp, Artificial sequence
  synthetic sequence
accgggggctactagaggag

SEQ ID NO: 9896 - DNA, 20 bp, Artificial sequence
  synthetic sequence
agccggccactggaaggact

SEQ ID NO: 9897 - DNA, 22 bp, Artificial sequence
  synthetic sequence
agaaggacgcagaccaagagaa

SEQ ID NO: 9898 - DNA, 18 bp, Artificial sequence
  synthetic sequence
acagccgcccatgcaacc

SEQ ID NO: 9899 - DNA, 20 bp, Artificial sequence
  synthetic sequence
aggctatccactgcacccaa

SEQ ID NO: 9900 - DNA, 19 bp, Artificial sequence
  synthetic sequence
aggactcgtggtgcaacgg

SEQ ID NO: 9901 - DNA, 21 bp, Artificial sequence
  synthetic sequence
aagccctgagaaggcgaacgt

SEQ ID NO: 9902 - DNA, 18 bp, Artificial sequence
  synthetic sequence
agaggagccagaggcccc

SEQ ID NO: 9903 - DNA, 19 bp, Artificial sequence
  synthetic sequence
aacccaccgtagtaccact

SEQ ID NO: 9904 - DNA, 19 bp, Artificial sequence
  synthetic sequence
acctccgtgggtgggaggg

SEQ ID NO: 9905 - DNA, 21 bp, Artificial sequence
  synthetic sequence
aagacgacgagaggttaggtc

SEQ ID NO: 9906 - DNA, 23 bp, Artificial sequence
  synthetic sequence
acgaccaggagactgaacaaaag

SEQ ID NO: 9907 - DNA, 20 bp, Artificial sequence
  synthetic sequence
acagacgaggaggaccgaag

SEQ ID NO: 9908 - DNA, 20 bp, Artificial sequence
  synthetic sequence
accacctgtacccccacccc

SEQ ID NO: 9909 - DNA, 18 bp, Artificial sequence
  synthetic sequence
acagcgacgtgcgtcgga

SEQ ID NO: 9910 - DNA, 20 bp, Artificial sequence
  synthetic sequence
acgagaacaggtcttccgtg

SEQ ID NO: 9911 - DNA, 19 bp, Artificial sequence
  synthetic sequence
agaggaggacgggtaagtc

SEQ ID NO: 9912 - DNA, 20 bp, Artificial sequence
  synthetic sequence
aaccgagaacccggagggtc

SEQ ID NO: 9913 - DNA, 20 bp, Artificial sequence
  synthetic sequence
aggtccgaccacacgaggtg

SEQ ID NO: 9914 - DNA, 20 bp, Artificial sequence
  synthetic sequence
acgaggtggaacgtcagtat

SEQ ID NO: 9915 - DNA, 25 bp, Artificial sequence
  synthetic sequence
agaggacatctaccactacgtggaa

SEQ ID NO: 9916 - DNA, 18 bp, Artificial sequence
  synthetic sequence
accccgagacctccgacc

SEQ ID NO: 9917 - DNA, 20 bp, Artificial sequence
  synthetic sequence
aggtcaggagctacgaggcg

SEQ ID NO: 9918 - DNA, 20 bp, Artificial sequence
  synthetic sequence
actcctgcaacccgagagag

SEQ ID NO: 9919 - DNA, 21 bp, Artificial sequence
  synthetic sequence
aaggtgacactctcccgaaca

SEQ ID NO: 9920 - DNA, 21 bp, Artificial sequence
  synthetic sequence
aagacttagtccggacacctg

SEQ ID NO: 9921 - DNA, 20 bp, Artificial sequence
  synthetic sequence
agacacgccacagggaccgc

SEQ ID NO: 9922 - DNA, 20 bp, Artificial sequence
  synthetic sequence
aaggagtcccggtgagccag

SEQ ID NO: 9923 - DNA, 19 bp, Artificial sequence
  synthetic sequence
agaccctcagaccaggggg

SEQ ID NO: 9924 - DNA, 19 bp, Artificial sequence
  synthetic sequence
agagaaccaccgaggctcg

SEQ ID NO: 9925 - DNA, 21 bp, Artificial sequence
  synthetic sequence
acgtgcaggaaactaccctct

SEQ ID NO: 9926 - DNA, 19 bp, Artificial sequence
  synthetic sequence
acgtaaccagaaccagtcg

SEQ ID NO: 9927 - DNA, 18 bp, Artificial sequence
  synthetic sequence
agacaggtgcaccgaacc

SEQ ID NO: 9928 - DNA, 22 bp, Artificial sequence
  synthetic sequence
acgaaggtaacgagacgaagtc

SEQ ID NO: 9929 - DNA, 20 bp, Artificial sequence
  synthetic sequence
agggaccctgagcgaagacg

SEQ ID NO: 9930 - DNA, 18 bp, Artificial sequence
  synthetic sequence
aacgcaaggtcccgtgac

SEQ ID NO: 9931 - DNA, 18 bp, Artificial sequence
  synthetic sequence
aacggtggaaaaggccac

SEQ ID NO: 9932 - DNA, 18 bp, Artificial sequence
  synthetic sequence
acgaacaccacatggggc

SEQ ID NO: 9933 - DNA, 21 bp, Artificial sequence
  synthetic sequence
agcatgagggggagcataagt

SEQ ID NO: 9934 - DNA, 18 bp, Artificial sequence
  synthetic sequence
agggcccagaccaagaac

SEQ ID NO: 9935 - DNA, 20 bp, Artificial sequence
  synthetic sequence
aagccccgactcacaaacac

SEQ ID NO: 9936 - DNA, 18 bp, Artificial sequence
  synthetic sequence
aacggagcactcgacctg

SEQ ID NO: 9937 - DNA, 20 bp, Artificial sequence
  synthetic sequence
agaccactgaacccgtccat

SEQ ID NO: 9938 - DNA, 22 bp, Artificial sequence
  synthetic sequence
agcgtctcataaacggggggaa

SEQ ID NO: 9939 - DNA, 18 bp, Artificial sequence
  synthetic sequence
agccaaggccatcgccga

SEQ ID NO: 9940 - DNA, 19 bp, Artificial sequence
  synthetic sequence
atcgacccccaacggaaag

SEQ ID NO: 9941 - DNA, 18 bp, Artificial sequence
  synthetic sequence
acccgcaaccgcacgtac

SEQ ID NO: 9942 - DNA, 18 bp, Artificial sequence
  synthetic sequence
aaggtggacgccgacgcc

SEQ ID NO: 9943 - DNA, 18 bp, Artificial sequence
  synthetic sequence
aggaggagcctgaggccc

SEQ ID NO: 9944 - DNA, 21 bp, Artificial sequence
  synthetic sequence
acgcaacctgtaagttcagtc

SEQ ID NO: 9945 - DNA, 23 bp, Artificial sequence
  synthetic sequence
agaaggaagacgcactcataaaa

SEQ ID NO: 9946 - DNA, 19 bp, Artificial sequence
  synthetic sequence
accgacctccaggcccatc

SEQ ID NO: 9947 - DNA, 18 bp, Artificial sequence
  synthetic sequence
agaggggcaacaaggacc

SEQ ID NO: 9948 - DNA, 18 bp, Artificial sequence
  synthetic sequence
aggagttgctacggtgcc

SEQ ID NO: 9949 - DNA, 20 bp, Artificial sequence
  synthetic sequence
aacacgtagacgggcagcag

SEQ ID NO: 9950 - DNA, 18 bp, Artificial sequence
  synthetic sequence
acctcccccaccttgaac

SEQ ID NO: 9951 - DNA, 18 bp, Artificial sequence
  synthetic sequence
acggcgacgagtcgtcag

SEQ ID NO: 9952 - DNA, 20 bp, Artificial sequence
  synthetic sequence
aggcagacagagactcggag

SEQ ID NO: 9953 - DNA, 20 bp, Artificial sequence
  synthetic sequence
acgaccacgccaactcttgg

SEQ ID NO: 9954 - DNA, 18 bp, Artificial sequence
  synthetic sequence
aggagaccagcgaggtgg

SEQ ID NO: 9955 - DNA, 20 bp, Artificial sequence
  synthetic sequence
aagggtccagtgacgtcgac

SEQ ID NO: 9956 - DNA, 20 bp, Artificial sequence
  synthetic sequence
agtgaggtaaggggtcgaaa

SEQ ID NO: 9957 - DNA, 18 bp, Artificial sequence
  synthetic sequence
aggaccaccggaaccgga

SEQ ID NO: 9958 - DNA, 18 bp, Artificial sequence
  synthetic sequence
acaccggtcaacctcgtc

SEQ ID NO: 9959 - DNA, 18 bp, Artificial sequence
  synthetic sequence
actcgaccgagggagccc

SEQ ID NO: 9960 - DNA, 20 bp, Artificial sequence
  synthetic sequence
aagcgaagttacgggaacaa

SEQ ID NO: 9961 - DNA, 21 bp, Artificial sequence
  synthetic sequence
agggtagtcgcaactacgtcg

SEQ ID NO: 9962 - DNA, 18 bp, Artificial sequence
  synthetic sequence
agacatccgggtcccgct

SEQ ID NO: 9963 - DNA, 19 bp, Artificial sequence
  synthetic sequence
agaggacgaagactgccgg

SEQ ID NO: 9964 - DNA, 18 bp, Artificial sequence
  synthetic sequence
acgggagcgagaacggtg

SEQ ID NO: 9965 - DNA, 19 bp, Artificial sequence
  synthetic sequence
agggccatcgcgtcacctc

SEQ ID NO: 9966 - DNA, 18 bp, Artificial sequence
  synthetic sequence
accggaccctatagtcgg

SEQ ID NO: 9967 - DNA, 19 bp, Artificial sequence
  synthetic sequence
aggaggcagaggacgttgc

SEQ ID NO: 9968 - DNA, 18 bp, Artificial sequence
  synthetic sequence
acagtccaactacgcccc

SEQ ID NO: 9969 - DNA, 19 bp, Artificial sequence
  synthetic sequence
aaccgaggagttccagggc

SEQ ID NO: 9970 - DNA, 21 bp, Artificial sequence
  synthetic sequence
acactgacgaggcacttcagg

SEQ ID NO: 9971 - DNA, 18 bp, Artificial sequence
  synthetic sequence
acaggtataggtccggcc

SEQ ID NO: 9972 - DNA, 20 bp, Artificial sequence
  synthetic sequence
aagggaagtggggtgagtcg

SEQ ID NO: 9973 - DNA, 18 bp, Artificial sequence
  synthetic sequence
accacggaaccctggaga

SEQ ID NO: 9974 - DNA, 19 bp, Artificial sequence
  synthetic sequence
aggtggaacagaagggcac

SEQ ID NO: 9975 - DNA, 21 bp, Artificial sequence
  synthetic sequence
accccacaatgtgaagtcctg

SEQ ID NO: 9976 - DNA, 20 bp, Artificial sequence
  synthetic sequence
acaccagggtcagtcaggcc

SEQ ID NO: 9977 - DNA, 21 bp, Artificial sequence
  synthetic sequence
agcatgacaactgcggacaac

SEQ ID NO: 9978 - DNA, 22 bp, Artificial sequence
  synthetic sequence
aggagatggaggaggaggagga

SEQ ID NO: 9979 - DNA, 21 bp, Artificial sequence
  synthetic sequence
agaggggtcacacagaaacga

SEQ ID NO: 9980 - DNA, 18 bp, Artificial sequence
  synthetic sequence
acggacgtacccccacct

SEQ ID NO: 9981 - DNA, 18 bp, Artificial sequence
  synthetic sequence
aggcgcagaggtgtcgcg

SEQ ID NO: 9982 - DNA, 21 bp, Artificial sequence
  synthetic sequence
aggtagaggggactcgataat

SEQ ID NO: 9983 - DNA, 20 bp, Artificial sequence
  synthetic sequence
aaccgcggaggaggaaccag

SEQ ID NO: 9984 - DNA, 18 bp, Artificial sequence
  synthetic sequence
aggtggacggggtggacg

SEQ ID NO: 9985 - DNA, 18 bp, Artificial sequence
  synthetic sequence
accgactgagcaactggc

SEQ ID NO: 9986 - DNA, 18 bp, Artificial sequence
  synthetic sequence
acacgactccccactggg

SEQ ID NO: 9987 - DNA, 23 bp, Artificial sequence
  synthetic sequence
agagagaaggacgcgaaaacgac

SEQ ID NO: 9988 - DNA, 18 bp, Artificial sequence
  synthetic sequence
accgacgtggagcaacag

SEQ ID NO: 9989 - DNA, 21 bp, Artificial sequence
  synthetic sequence
acacgcctaaccgactcaacc

SEQ ID NO: 9990 - DNA, 20 bp, Artificial sequence
  synthetic sequence
acagaatggtaggggtggac

SEQ ID NO: 9991 - DNA, 21 bp, Artificial sequence
  synthetic sequence
acccccaagtcagtccaagac

SEQ ID NO: 9992 - DNA, 21 bp, Artificial sequence
  synthetic sequence
agggcacctaccccttgttcg

SEQ ID NO: 9993 - DNA, 18 bp, Artificial sequence
  synthetic sequence
acacgagccccgttgaga

SEQ ID NO: 9994 - DNA, 18 bp, Artificial sequence
  synthetic sequence
agcaaccgacgcaggtag

SEQ ID NO: 9995 - DNA, 18 bp, Artificial sequence
  synthetic sequence
acacccctactaccggac

SEQ ID NO: 9996 - DNA, 21 bp, Artificial sequence
  synthetic sequence
aagccatcatacgaccgaggc

SEQ ID NO: 9997 - DNA, 20 bp, Artificial sequence
  synthetic sequence
accaccacgtcaactcaggg

SEQ ID NO: 9998 - DNA, 18 bp, Artificial sequence
  synthetic sequence
acggacgtaaaccgtcgg

SEQ ID NO: 9999 - DNA, 18 bp, Artificial sequence
  synthetic sequence
agggcgagtctgacgtac

SEQ ID NO: 10000 - DNA, 22 bp, Artificial sequence
  synthetic sequence
accaggttggaggaggagaaac

SEQ ID NO: 10001 - DNA, 18 bp, Artificial sequence
  synthetic sequence
aaccggtgcagtcggtag

SEQ ID NO: 10002 - DNA, 20 bp, Artificial sequence
  synthetic sequence
agagggagacacccgtactc

SEQ ID NO: 10003 - DNA, 18 bp, Artificial sequence
  synthetic sequence
aagccctgtggagacggt

SEQ ID NO: 10004 - DNA, 20 bp, Artificial sequence
  synthetic sequence
accacaccgtgcatgagctc

SEQ ID NO: 10005 - DNA, 18 bp, Artificial sequence
  synthetic sequence
accagggcgagtggaacg

SEQ ID NO: 10006 - DNA, 20 bp, Artificial sequence
  synthetic sequence
acgactgtccgtccagggag

SEQ ID NO: 10007 - DNA, 22 bp, Artificial sequence
  synthetic sequence
acagggctgaaagatggaacca

SEQ ID NO: 10008 - DNA, 18 bp, Artificial sequence
  synthetic sequence
accggcaacatcgcgagt

SEQ ID NO: 10009 - DNA, 19 bp, Artificial sequence
  synthetic sequence
agcagtacatcccgagggg

SEQ ID NO: 10010 - DNA, 19 bp, Artificial sequence
  synthetic sequence
aacgggaagaccaggaggc

SEQ ID NO: 10011 - DNA, 18 bp, Artificial sequence
  synthetic sequence
agcgacgtctagaccggt

SEQ ID NO: 10012 - DNA, 18 bp, Artificial sequence
  synthetic sequence
aaggcgacgtcctcccta

SEQ ID NO: 10013 - DNA, 18 bp, Artificial sequence
  synthetic sequence
agggccacagagagcgta

SEQ ID NO: 10014 - DNA, 18 bp, Artificial sequence
  synthetic sequence
acgacccgacgacgactt

SEQ ID NO: 10015 - DNA, 18 bp, Artificial sequence
  synthetic sequence
acgaccggagaccgaaga

SEQ ID NO: 10016 - DNA, 20 bp, Artificial sequence
  synthetic sequence
agacccaggaacgtcaggtg

SEQ ID NO: 10017 - DNA, 19 bp, Artificial sequence
  synthetic sequence
accggagtccgtggaacgc

SEQ ID NO: 10018 - DNA, 18 bp, Artificial sequence
  synthetic sequence
aaggaccgtgaaccgtgg

SEQ ID NO: 10019 - DNA, 18 bp, Artificial sequence
  synthetic sequence
aacggcatgaccagcgtc

SEQ ID NO: 10020 - DNA, 21 bp, Artificial sequence
  synthetic sequence
aggggcgtagtgaagaacagt

SEQ ID NO: 10021 - DNA, 20 bp, Artificial sequence
  synthetic sequence
agaggacgaggagtgtggac

SEQ ID NO: 10022 - DNA, 18 bp, Artificial sequence
  synthetic sequence
aagctccgagaaggcccg

SEQ ID NO: 10023 - DNA, 18 bp, Artificial sequence
  synthetic sequence
acagcaagccggtcgagc

SEQ ID NO: 10024 - DNA, 19 bp, Artificial sequence
  synthetic sequence
acccagagactgacccgag

SEQ ID NO: 10025 - DNA, 20 bp, Artificial sequence
  synthetic sequence
accacggcattgtcggagaa

SEQ ID NO: 10026 - DNA, 19 bp, Artificial sequence
  synthetic sequence
accgaacaaccttgaccct

SEQ ID NO: 10027 - DNA, 18 bp, Artificial sequence
  synthetic sequence
acacgtccacagccccca

SEQ ID NO: 10028 - DNA, 21 bp, Artificial sequence
  synthetic sequence
agccggaccttacaaggcaac

SEQ ID NO: 10029 - DNA, 23 bp, Artificial sequence
  synthetic sequence
acacaaaagagaggtcgtccgtc

SEQ ID NO: 10030 - DNA, 21 bp, Artificial sequence
  synthetic sequence
agagaggacggacttggaacc

SEQ ID NO: 10031 - DNA, 23 bp, Artificial sequence
  synthetic sequence
aaccctaaaaccgacgagaaagg

SEQ ID NO: 10032 - DNA, 20 bp, Artificial sequence
  synthetic sequence
acgaaagtccacggtaggtg

SEQ ID NO: 10033 - DNA, 23 bp, Artificial sequence
  synthetic sequence
aggacgtctagggaagtcaaaac

SEQ ID NO: 10034 - DNA, 18 bp, Artificial sequence
  synthetic sequence
acccggactcagacaccc

SEQ ID NO: 10035 - DNA, 22 bp, Artificial sequence
  synthetic sequence
agcaacgacggagaaacccaaa

SEQ ID NO: 10036 - DNA, 22 bp, Artificial sequence
  synthetic sequence
agagacctccaccgtcatttgg

SEQ ID NO: 10037 - DNA, 21 bp, Artificial sequence
  synthetic sequence
acccaggacctcatttacgac

SEQ ID NO: 10038 - DNA, 22 bp, Artificial sequence
  synthetic sequence
aacccgtcttgaggaaaagaaa

SEQ ID NO: 10039 - DNA, 21 bp, Artificial sequence
  synthetic sequence
aacctcgtccgagtaaaggac

SEQ ID NO: 10040 - DNA, 20 bp, Artificial sequence
  synthetic sequence
agagggtcgacacagctctg

SEQ ID NO: 10041 - DNA, 18 bp, Artificial sequence
  synthetic sequence
acgaggagaaggggtgcc

SEQ ID NO: 10042 - DNA, 18 bp, Artificial sequence
  synthetic sequence
agccccgtgtaagaggtc

SEQ ID NO: 10043 - DNA, 21 bp, Artificial sequence
  synthetic sequence
aacgacatcagtgctccgagg

SEQ ID NO: 10044 - DNA, 20 bp, Artificial sequence
  synthetic sequence
acacaggtgtgccccccgga

SEQ ID NO: 10045 - DNA, 18 bp, Artificial sequence
  synthetic sequence
agagccaagaaggctcgg

SEQ ID NO: 10046 - DNA, 21 bp, Artificial sequence
  synthetic sequence
acgactctaccctgacctcaa

SEQ ID NO: 10047 - DNA, 18 bp, Artificial sequence
  synthetic sequence
acgcagacgtagaccctg

SEQ ID NO: 10048 - DNA, 21 bp, Artificial sequence
  synthetic sequence
agacgtagggtctgaggtcgg

SEQ ID NO: 10049 - DNA, 18 bp, Artificial sequence
  synthetic sequence
acggccttgtaggagagg

SEQ ID NO: 10050 - DNA, 20 bp, Artificial sequence
  synthetic sequence
agagggtctcgcaacccgtg

SEQ ID NO: 10051 - DNA, 18 bp, Artificial sequence
  synthetic sequence
actgacaacaggctgccg

SEQ ID NO: 10052 - DNA, 18 bp, Artificial sequence
  synthetic sequence
aggagggagaggtccgcc

SEQ ID NO: 10053 - DNA, 20 bp, Artificial sequence
  synthetic sequence
accccagtgtccacagtgac

SEQ ID NO: 10054 - DNA, 20 bp, Artificial sequence
  synthetic sequence
acgggtagtcactcgaggtg

SEQ ID NO: 10055 - DNA, 18 bp, Artificial sequence
  synthetic sequence
accactgacggtggctca

SEQ ID NO: 10056 - DNA, 19 bp, Artificial sequence
  synthetic sequence
acacaggagtcccaggtcc

SEQ ID NO: 10057 - DNA, 18 bp, Artificial sequence
  synthetic sequence
acaccaacgagacgcgca

SEQ ID NO: 10058 - DNA, 18 bp, Artificial sequence
  synthetic sequence
accgaaacagcgtgaccg

SEQ ID NO: 10059 - DNA, 18 bp, Artificial sequence
  synthetic sequence
acgagtgggggacacact

SEQ ID NO: 10060 - DNA, 18 bp, Artificial sequence
  synthetic sequence
accgacgtagtcacagcc

SEQ ID NO: 10061 - DNA, 18 bp, Artificial sequence
  synthetic sequence
aggaccggtcagtgcact

SEQ ID NO: 10062 - DNA, 20 bp, Artificial sequence
  synthetic sequence
acgggagagaaggtcgagac

SEQ ID NO: 10063 - DNA, 20 bp, Artificial sequence
  synthetic sequence
aagcactgtgcctgcacgag

SEQ ID NO: 10064 - DNA, 22 bp, Artificial sequence
  synthetic sequence
aggactcactacaagtcgacgt

SEQ ID NO: 10065 - DNA, 19 bp, Artificial sequence
  synthetic sequence
acccgactgttgacctccg

SEQ ID NO: 10066 - DNA, 18 bp, Artificial sequence
  synthetic sequence
agcccaccaacacacgac

SEQ ID NO: 10067 - DNA, 18 bp, Artificial sequence
  synthetic sequence
accaggacggagggagga

SEQ ID NO: 10068 - DNA, 20 bp, Artificial sequence
  synthetic sequence
acacgaacgagacaggtgtc

SEQ ID NO: 10069 - DNA, 18 bp, Artificial sequence
  synthetic sequence
agacctaccacccctcca

SEQ ID NO: 10070 - DNA, 21 bp, Artificial sequence
  synthetic sequence
acctctgagggcactcgtaca

SEQ ID NO: 10071 - DNA, 20 bp, Artificial sequence
  synthetic sequence
acacgtcagggaggtcgaag

SEQ ID NO: 10072 - DNA, 18 bp, Artificial sequence
  synthetic sequence
acactacccgactcccac

SEQ ID NO: 10073 - DNA, 20 bp, Artificial sequence
  synthetic sequence
accaagacgactcgaaccac

SEQ ID NO: 10074 - DNA, 21 bp, Artificial sequence
  synthetic sequence
agagaggactccagtggcacc

SEQ ID NO: 10075 - DNA, 18 bp, Artificial sequence
  synthetic sequence
acaccgacccccagtgtc

SEQ ID NO: 10076 - DNA, 18 bp, Artificial sequence
  synthetic sequence
acgggactgcagctacag

SEQ ID NO: 10077 - DNA, 18 bp, Artificial sequence
  synthetic sequence
accccgaccctcaagtcc

SEQ ID NO: 10078 - DNA, 21 bp, Artificial sequence
  synthetic sequence
aaggacctgcagtcgtcgacc

SEQ ID NO: 10079 - DNA, 19 bp, Artificial sequence
  synthetic sequence
accccctgactgggacatc

SEQ ID NO: 10080 - DNA, 20 bp, Artificial sequence
  synthetic sequence
aggaggagccacatctggtc

SEQ ID NO: 10081 - DNA, 18 bp, Artificial sequence
  synthetic sequence
agaggagcagcccgcaca

SEQ ID NO: 10082 - DNA, 18 bp, Artificial sequence
  synthetic sequence
aacgcctgttaccgacac

SEQ ID NO: 10083 - DNA, 20 bp, Artificial sequence
  synthetic sequence
aagcccacatccgactcaag

SEQ ID NO: 10084 - DNA, 18 bp, Artificial sequence
  synthetic sequence
agcagcgggtggtacggc

SEQ ID NO: 10085 - DNA, 18 bp, Artificial sequence
  synthetic sequence
aggcatcccggtcaggta

SEQ ID NO: 10086 - DNA, 20 bp, Artificial sequence
  synthetic sequence
accactgccgcctggaaagc

SEQ ID NO: 10087 - DNA, 20 bp, Artificial sequence
  synthetic sequence
aggggtcgccaccacttgac

SEQ ID NO: 10088 - DNA, 21 bp, Artificial sequence
  synthetic sequence
aggcaaccacgaccttcggga

SEQ ID NO: 10089 - DNA, 19 bp, Artificial sequence
  synthetic sequence
accgagatccccgtcactc

SEQ ID NO: 10090 - DNA, 21 bp, Artificial sequence
  synthetic sequence
aggaggacacctcatccgacg

SEQ ID NO: 10091 - DNA, 25 bp, Artificial sequence
  synthetic sequence
accaacagattcgggaacaggaact

SEQ ID NO: 10092 - DNA, 21 bp, Artificial sequence
  synthetic sequence
aagtgtgacacacggactggt

SEQ ID NO: 10093 - DNA, 19 bp, Artificial sequence
  synthetic sequence
agcgagagacacgtgaggg

SEQ ID NO: 10094 - DNA, 18 bp, Artificial sequence
  synthetic sequence
acggcaactccaaccgtg

SEQ ID NO: 10095 - DNA, 20 bp, Artificial sequence
  synthetic sequence
aggaggtccgactgaaggag

SEQ ID NO: 10096 - DNA, 20 bp, Artificial sequence
  synthetic sequence
acaggcagggattggatccg

SEQ ID NO: 10097 - DNA, 21 bp, Artificial sequence
  synthetic sequence
acgaccgaccgggtgtttgta

SEQ ID NO: 10098 - DNA, 18 bp, Artificial sequence
  synthetic sequence
aacggcgtcgtcgactca

SEQ ID NO: 10099 - DNA, 18 bp, Artificial sequence
  synthetic sequence
acgccgtaaactcgagcc

SEQ ID NO: 10100 - DNA, 21 bp, Artificial sequence
  synthetic sequence
acagacggggaacctgtaaga

SEQ ID NO: 10101 - DNA, 20 bp, Artificial sequence
  synthetic sequence
agtcaagccgagacgcctgg

SEQ ID NO: 10102 - DNA, 22 bp, Artificial sequence
  synthetic sequence
agcaaccgtcgaaacgtgagta

SEQ ID NO: 10103 - DNA, 19 bp, Artificial sequence
  synthetic sequence
aaggacgtcgggacctatg

SEQ ID NO: 10104 - DNA, 23 bp, Artificial sequence
  synthetic sequence
acccttagaaacaaaggaccccg

SEQ ID NO: 10105 - DNA, 18 bp, Artificial sequence
  synthetic sequence
aacggtgaagaccgaggc

SEQ ID NO: 10106 - DNA, 18 bp, Artificial sequence
  synthetic sequence
acggagcgtgagcaagtg

SEQ ID NO: 10107 - DNA, 18 bp, Artificial sequence
  synthetic sequence
agagacccccgtcaccga

SEQ ID NO: 10108 - DNA, 18 bp, Artificial sequence
  synthetic sequence
aggcaaacggtagctccg

SEQ ID NO: 10109 - DNA, 20 bp, Artificial sequence
  synthetic sequence
acacccccagaatccgtgag

SEQ ID NO: 10110 - DNA, 20 bp, Artificial sequence
  synthetic sequence
aacccatcgaaagtcccgtc

SEQ ID NO: 10111 - DNA, 18 bp, Artificial sequence
  synthetic sequence
agcaggcaagcgaccctc

SEQ ID NO: 10112 - DNA, 21 bp, Artificial sequence
  synthetic sequence
agacgttgcagacagacgaaa

SEQ ID NO: 10113 - DNA, 18 bp, Artificial sequence
  synthetic sequence
acccgaacacgtggagtc

SEQ ID NO: 10114 - DNA, 18 bp, Artificial sequence
  synthetic sequence
aacgacgccaggaccacc

SEQ ID NO: 10115 - DNA, 18 bp, Artificial sequence
  synthetic sequence
agtcgacgaccaagcgga

SEQ ID NO: 10116 - DNA, 21 bp, Artificial sequence
  synthetic sequence
atcgtcaggtcaggaggtcgt

SEQ ID NO: 10117 - DNA, 20 bp, Artificial sequence
  synthetic sequence
acgtgggagaacttcgccgt

SEQ ID NO: 10118 - DNA, 20 bp, Artificial sequence
  synthetic sequence
agggtgactaccggggactc

SEQ ID NO: 10119 - DNA, 18 bp, Artificial sequence
  synthetic sequence
aggggagctaccggaaag

SEQ ID NO: 10120 - DNA, 18 bp, Artificial sequence
  synthetic sequence
aacgactcagcagcccca

SEQ ID NO: 10121 - DNA, 19 bp, Artificial sequence
  synthetic sequence
acgagggactacaggtccc

SEQ ID NO: 10122 - DNA, 17 bp, Artificial sequence
  synthetic sequence
agacggcggaggcgacc

SEQ ID NO: 10123 - DNA, 19 bp, Artificial sequence
  synthetic sequence
agggaccagagggaagacc

SEQ ID NO: 10124 - DNA, 19 bp, Artificial sequence
  synthetic sequence
acactgaagaccccgtccc

SEQ ID NO: 10125 - DNA, 18 bp, Artificial sequence
  synthetic sequence
aacggcacggcaactgca

SEQ ID NO: 10126 - DNA, 21 bp, Artificial sequence
  synthetic sequence
agcaggggtaactactcgctc

SEQ ID NO: 10127 - DNA, 20 bp, Artificial sequence
  synthetic sequence
agggagactcaggtgacgtc

SEQ ID NO: 10128 - DNA, 20 bp, Artificial sequence
  synthetic sequence
aaggcacctcgtcaacgccg

SEQ ID NO: 10129 - DNA, 20 bp, Artificial sequence
  synthetic sequence
agacctagagccctcacctc

SEQ ID NO: 10130 - DNA, 18 bp, Artificial sequence
  synthetic sequence
agcccgacgaagttggac

SEQ ID NO: 10131 - DNA, 18 bp, Artificial sequence
  synthetic sequence
acacaacagggcaccggt

SEQ ID NO: 10132 - DNA, 20 bp, Artificial sequence
  synthetic sequence
agacgaagacggtaggtcaa

SEQ ID NO: 10133 - DNA, 20 bp, Artificial sequence
  synthetic sequence
acaggtgggagaaccagtag

SEQ ID NO: 10134 - DNA, 18 bp, Artificial sequence
  synthetic sequence
aggaggagacgcgactgg

SEQ ID NO: 10135 - DNA, 20 bp, Artificial sequence
  synthetic sequence
aggatgaaaccgaccgctta

SEQ ID NO: 10136 - DNA, 20 bp, Artificial sequence
  synthetic sequence
acccactactacggacagtg

SEQ ID NO: 10137 - DNA, 22 bp, Artificial sequence
  synthetic sequence
agtccgacggttacaacgagtt

SEQ ID NO: 10138 - DNA, 20 bp, Artificial sequence
  synthetic sequence
agacgtcgactgtcggacac

SEQ ID NO: 10139 - DNA, 18 bp, Artificial sequence
  synthetic sequence
aacgggagactccggagc

SEQ ID NO: 10140 - DNA, 18 bp, Artificial sequence
  synthetic sequence
acgacccacaacaccgag

SEQ ID NO: 10141 - DNA, 20 bp, Artificial sequence
  synthetic sequence
acacagaggtgccagggacc

SEQ ID NO: 10142 - DNA, 18 bp, Artificial sequence
  synthetic sequence
accccgactatgtagggc

SEQ ID NO: 10143 - DNA, 18 bp, Artificial sequence
  synthetic sequence
aaccaagcccgtccgtca

SEQ ID NO: 10144 - DNA, 21 bp, Artificial sequence
  synthetic sequence
acccactaaagcacaggatac

SEQ ID NO: 10145 - DNA, 23 bp, Artificial sequence
  synthetic sequence
aagacgccgacgtgtcataaacc

SEQ ID NO: 10146 - DNA, 22 bp, Artificial sequence
  synthetic sequence
acgtaaagagcctcggagagtc

SEQ ID NO: 10147 - DNA, 20 bp, Artificial sequence
  synthetic sequence
aggaaagggtggaccctgta

SEQ ID NO: 10148 - DNA, 20 bp, Artificial sequence
  synthetic sequence
aaccccactatcgtgagcac

SEQ ID NO: 10149 - DNA, 18 bp, Artificial sequence
  synthetic sequence
agccaaggaccaggtcca

SEQ ID NO: 10150 - DNA, 18 bp, Artificial sequence
  synthetic sequence
accgccagaggtgggatc

SEQ ID NO: 10151 - DNA, 18 bp, Artificial sequence
  synthetic sequence
agacgtggcacaactcgt

SEQ ID NO: 10152 - DNA, 21 bp, Artificial sequence
  synthetic sequence
aagctgcgcaggaaaggaccg

SEQ ID NO: 10153 - DNA, 20 bp, Artificial sequence
  synthetic sequence
aacgggaaccctcatcacct

SEQ ID NO: 10154 - DNA, 20 bp, Artificial sequence
  synthetic sequence
agtccacccaagaagtggac

SEQ ID NO: 10155 - DNA, 18 bp, Artificial sequence
  synthetic sequence
acgggtgcggactatcca

SEQ ID NO: 10156 - DNA, 18 bp, Artificial sequence
  synthetic sequence
aacccaagccctcagcag

SEQ ID NO: 10157 - DNA, 20 bp, Artificial sequence
  synthetic sequence
acccctgtcgacggtaccat

SEQ ID NO: 10158 - DNA, 21 bp, Artificial sequence
  synthetic sequence
accggtcctactgcaccaact

SEQ ID NO: 10159 - DNA, 20 bp, Artificial sequence
  synthetic sequence
atcccggaaagtaaccgaga

SEQ ID NO: 10160 - DNA, 18 bp, Artificial sequence
  synthetic sequence
acgtcaccacccctactc

SEQ ID NO: 10161 - DNA, 19 bp, Artificial sequence
  synthetic sequence
acagatcgaccggggaagg

SEQ ID NO: 10162 - DNA, 22 bp, Artificial sequence
  synthetic sequence
acacaggtactccaaccgaagg

SEQ ID NO: 10163 - DNA, 18 bp, Artificial sequence
  synthetic sequence
agcacgaccgtcgagagt

SEQ ID NO: 10164 - DNA, 20 bp, Artificial sequence
  synthetic sequence
acacagaggtgcagcacctg

SEQ ID NO: 10165 - DNA, 22 bp, Artificial sequence
  synthetic sequence
acccctaacacgaccggtaaac

SEQ ID NO: 10166 - DNA, 18 bp, Artificial sequence
  synthetic sequence
acgcagcactccgagttc

SEQ ID NO: 10167 - DNA, 20 bp, Artificial sequence
  synthetic sequence
acgatagagggcgtgtcacc

SEQ ID NO: 10168 - DNA, 18 bp, Artificial sequence
  synthetic sequence
acaccccagacccggacc

SEQ ID NO: 10169 - DNA, 18 bp, Artificial sequence
  synthetic sequence
accggacccaagcccatt

SEQ ID NO: 10170 - DNA, 18 bp, Artificial sequence
  synthetic sequence
acgacgtccgccaagaac

SEQ ID NO: 10171 - DNA, 20 bp, Artificial sequence
  synthetic sequence
acggtcccgtgcaacgaaag

SEQ ID NO: 10172 - DNA, 18 bp, Artificial sequence
  synthetic sequence
aaggcgagctagagacgg

SEQ ID NO: 10173 - DNA, 18 bp, Artificial sequence
  synthetic sequence
aaccagaggtcccaccgt

SEQ ID NO: 10174 - DNA, 18 bp, Artificial sequence
  synthetic sequence
aggaagtcgacgaacccg

SEQ ID NO: 10175 - DNA, 22 bp, Artificial sequence
  synthetic sequence
aggagtatccacggacacagga

SEQ ID NO: 10176 - DNA, 22 bp, Artificial sequence
  synthetic sequence
agacgaccgtaaagaggcgaaa

SEQ ID NO: 10177 - DNA, 20 bp, Artificial sequence
  synthetic sequence
aaccctggcctcacgtgacc

SEQ ID NO: 10178 - DNA, 22 bp, Artificial sequence
  synthetic sequence
agagagtcctcctccgagtaga

SEQ ID NO: 10179 - DNA, 19 bp, Artificial sequence
  synthetic sequence
accgacgtcaatctccccg

SEQ ID NO: 10180 - DNA, 18 bp, Artificial sequence
  synthetic sequence
acggaaaccctgaccacc

SEQ ID NO: 10181 - DNA, 19 bp, Artificial sequence
  synthetic sequence
accggagactgagtgacgg

SEQ ID NO: 10182 - DNA, 18 bp, Artificial sequence
  synthetic sequence
accgcccaagacctctcg

SEQ ID NO: 10183 - DNA, 20 bp, Artificial sequence
  synthetic sequence
agacccagggcgaacagtcg

SEQ ID NO: 10184 - DNA, 21 bp, Artificial sequence
  synthetic sequence
agaagtccacgttccgaccac

SEQ ID NO: 10185 - DNA, 21 bp, Artificial sequence
  synthetic sequence
acctctgagtccccgaacaga

SEQ ID NO: 10186 - DNA, 19 bp, Artificial sequence
  synthetic sequence
agcgtgcagggcctacacg

SEQ ID NO: 10187 - DNA, 18 bp, Artificial sequence
  synthetic sequence
acccaacagagcgttccg

SEQ ID NO: 10188 - DNA, 18 bp, Artificial sequence
  synthetic sequence
aggaccgtgacgagagcc

SEQ ID NO: 10189 - DNA, 20 bp, Artificial sequence
  synthetic sequence
aggcgacgtccatggtcaac

SEQ ID NO: 10190 - DNA, 18 bp, Artificial sequence
  synthetic sequence
accaaggtaccctggtcc

SEQ ID NO: 10191 - DNA, 22 bp, Artificial sequence
  synthetic sequence
agcggaaggagatcgtttagac

SEQ ID NO: 10192 - DNA, 19 bp, Artificial sequence
  synthetic sequence
accgaaggaccatcctccg

SEQ ID NO: 10193 - DNA, 18 bp, Artificial sequence
  synthetic sequence
acgaagggtgcgaccact

SEQ ID NO: 10194 - DNA, 20 bp, Artificial sequence
  synthetic sequence
acgaggacacagtgcaacca

SEQ ID NO: 10195 - DNA, 18 bp, Artificial sequence
  synthetic sequence
aaccccgttcactcaccg

SEQ ID NO: 10196 - DNA, 22 bp, Artificial sequence
  synthetic sequence
acccccataaagcttgcctaac

SEQ ID NO: 10197 - DNA, 21 bp, Artificial sequence
  synthetic sequence
agacctacacgacccaacctc

SEQ ID NO: 10198 - DNA, 18 bp, Artificial sequence
  synthetic sequence
agccgcctgccaagcaca

SEQ ID NO: 10199 - DNA, 22 bp, Artificial sequence
  synthetic sequence
acggtggtagtagagaagggtc

SEQ ID NO: 10200 - DNA, 19 bp, Artificial sequence
  synthetic sequence
acgactagacccacagggc

SEQ ID NO: 10201 - DNA, 19 bp, Artificial sequence
  synthetic sequence
aggagtctggctccgtctc

SEQ ID NO: 10202 - DNA, 18 bp, Artificial sequence
  synthetic sequence
acacgagcccgaccatcg

SEQ ID NO: 10203 - DNA, 20 bp, Artificial sequence
  synthetic sequence
agcagagtccgagacgaggg

SEQ ID NO: 10204 - DNA, 18 bp, Artificial sequence
  synthetic sequence
aagcgaagaacggccgca

SEQ ID NO: 10205 - DNA, 20 bp, Artificial sequence
  synthetic sequence
agacccccagcagaccataa

SEQ ID NO: 10206 - DNA, 18 bp, Artificial sequence
  synthetic sequence
accacggtgggtaaccac

SEQ ID NO: 10207 - DNA, 21 bp, Artificial sequence
  synthetic sequence
acacagcacacggacgtcgct

SEQ ID NO: 10208 - DNA, 18 bp, Artificial sequence
  synthetic sequence
acgaccttccggtccacg

SEQ ID NO: 10209 - DNA, 18 bp, Artificial sequence
  synthetic sequence
acggaagggcacctagag

SEQ ID NO: 10210 - DNA, 18 bp, Artificial sequence
  synthetic sequence
aacgactagggcgtcgtg

SEQ ID NO: 10211 - DNA, 20 bp, Artificial sequence
  synthetic sequence
agagcgtcaacccaggacac

SEQ ID NO: 10212 - DNA, 18 bp, Artificial sequence
  synthetic sequence
accggcagctagttaccc

SEQ ID NO: 10213 - DNA, 19 bp, Artificial sequence
  synthetic sequence
agagcatgtggcccaacgt

SEQ ID NO: 10214 - DNA, 19 bp, Artificial sequence
  synthetic sequence
acggaaggcctcagtctcc

SEQ ID NO: 10215 - DNA, 22 bp, Artificial sequence
  synthetic sequence
aggcgtgaaaccgaacagaaac

SEQ ID NO: 10216 - DNA, 18 bp, Artificial sequence
  synthetic sequence
actgaaggggccaggtcc

SEQ ID NO: 10217 - DNA, 20 bp, Artificial sequence
  synthetic sequence
acaggaacgagacccaggtc

SEQ ID NO: 10218 - DNA, 18 bp, Artificial sequence
  synthetic sequence
accacgtaccgcaactgg

SEQ ID NO: 10219 - DNA, 20 bp, Artificial sequence
  synthetic sequence
agaggtgaccagtacggtac

SEQ ID NO: 10220 - DNA, 19 bp, Artificial sequence
  synthetic sequence
acgaaatcctcgcgactgt

SEQ ID NO: 10221 - DNA, 21 bp, Artificial sequence
  synthetic sequence
acgggtcgaagagaggcagga

SEQ ID NO: 10222 - DNA, 22 bp, Artificial sequence
  synthetic sequence
aaccaaagtgacctggacatga

SEQ ID NO: 10223 - DNA, 20 bp, Artificial sequence
  synthetic sequence
agcggaccccaggtactgtc

SEQ ID NO: 10224 - DNA, 19 bp, Artificial sequence
  synthetic sequence
agagagccacgaagggtgg

SEQ ID NO: 10225 - DNA, 18 bp, Artificial sequence
  synthetic sequence
acaccggaggagaagcca

SEQ ID NO: 10226 - DNA, 18 bp, Artificial sequence
  synthetic sequence
accggcatcgccacgtgc

SEQ ID NO: 10227 - DNA, 20 bp, Artificial sequence
  synthetic sequence
aacgatacgtccactccgat

SEQ ID NO: 10228 - DNA, 18 bp, Artificial sequence
  synthetic sequence
acacgggcagcgcccagc

SEQ ID NO: 10229 - DNA, 18 bp, Artificial sequence
  synthetic sequence
agggaggcaagaccgtca

SEQ ID NO: 10230 - DNA, 20 bp, Artificial sequence
  synthetic sequence
agagcctgcggaggaagtca

SEQ ID NO: 10231 - DNA, 19 bp, Artificial sequence
  synthetic sequence
aggagtacaccccgagagc

SEQ ID NO: 10232 - DNA, 18 bp, Artificial sequence
  synthetic sequence
aaggaccaccggtccaga

SEQ ID NO: 10233 - DNA, 21 bp, Artificial sequence
  synthetic sequence
accacctcgactgcatcttct

SEQ ID NO: 10234 - DNA, 19 bp, Artificial sequence
  synthetic sequence
aggcacagtggagacggag

SEQ ID NO: 10235 - DNA, 18 bp, Artificial sequence
  synthetic sequence
accccagctacacctcct

SEQ ID NO: 10236 - DNA, 20 bp, Artificial sequence
  synthetic sequence
acctgccgaaggagaaccac

SEQ ID NO: 10237 - DNA, 20 bp, Artificial sequence
  synthetic sequence
agcgggcgtaacgacatcga

SEQ ID NO: 10238 - DNA, 21 bp, Artificial sequence
  synthetic sequence
accaggttcatctccttccac

SEQ ID NO: 10239 - DNA, 18 bp, Artificial sequence
  synthetic sequence
acgcccagaactcctacc

SEQ ID NO: 10240 - DNA, 18 bp, Artificial sequence
  synthetic sequence
accggaaggacgaccaac

SEQ ID NO: 10241 - DNA, 19 bp, Artificial sequence
  synthetic sequence
agacacacgagtccaggcg

SEQ ID NO: 10242 - DNA, 18 bp, Artificial sequence
  synthetic sequence
aggagtagtcgacggtcc

SEQ ID NO: 10243 - DNA, 18 bp, Artificial sequence
  synthetic sequence
agcgcctccggtaggtac

SEQ ID NO: 10244 - DNA, 21 bp, Artificial sequence
  synthetic sequence
agagtagtccgaccaggaagt

SEQ ID NO: 10245 - DNA, 18 bp, Artificial sequence
  synthetic sequence
acgaccgtaaccacaagg

SEQ ID NO: 10246 - DNA, 18 bp, Artificial sequence
  synthetic sequence
acgagaaccggagggtgc

SEQ ID NO: 10247 - DNA, 20 bp, Artificial sequence
  synthetic sequence
acgcgcctcaccgccatgac

SEQ ID NO: 10248 - DNA, 20 bp, Artificial sequence
  synthetic sequence
acaccacggagatgacccaa

SEQ ID NO: 10249 - DNA, 20 bp, Artificial sequence
  synthetic sequence
acacgcctgacgacggcttc

SEQ ID NO: 10250 - DNA, 18 bp, Artificial sequence
  synthetic sequence
accggggaccaggccctt

SEQ ID NO: 10251 - DNA, 20 bp, Artificial sequence
  synthetic sequence
actccaccactacgtccggg

SEQ ID NO: 10252 - DNA, 21 bp, Artificial sequence
  synthetic sequence
agacggagagtgactagggaa

SEQ ID NO: 10253 - DNA, 20 bp, Artificial sequence
  synthetic sequence
acgacaccggacccgataca

SEQ ID NO: 10254 - DNA, 18 bp, Artificial sequence
  synthetic sequence
aggaggcacgcgttgtcg

SEQ ID NO: 10255 - DNA, 18 bp, Artificial sequence
  synthetic sequence
aacggaagaacggggtcg

SEQ ID NO: 10256 - DNA, 21 bp, Artificial sequence
  synthetic sequence
agcgagacgtcactcaagaag

SEQ ID NO: 10257 - DNA, 21 bp, Artificial sequence
  synthetic sequence
accctttccaccaccaccaga

SEQ ID NO: 10258 - DNA, 19 bp, Artificial sequence
  synthetic sequence
acccatcaactccccgtcc

SEQ ID NO: 10259 - DNA, 20 bp, Artificial sequence
  synthetic sequence
acgaccagtgacggagacct

SEQ ID NO: 10260 - DNA, 19 bp, Artificial sequence
  synthetic sequence
accacctcaactcccctcc

SEQ ID NO: 10261 - DNA, 18 bp, Artificial sequence
  synthetic sequence
acacctacgacgacgacc

SEQ ID NO: 10262 - DNA, 21 bp, Artificial sequence
  synthetic sequence
aaccccgacgtctaccagtgt

SEQ ID NO: 10263 - DNA, 19 bp, Artificial sequence
  synthetic sequence
aaccggagagaggagcgac

SEQ ID NO: 10264 - DNA, 20 bp, Artificial sequence
  synthetic sequence
aggacccactcaccctacac

SEQ ID NO: 10265 - DNA, 20 bp, Artificial sequence
  synthetic sequence
acgaaccggtccagtcctga

SEQ ID NO: 10266 - DNA, 19 bp, Artificial sequence
  synthetic sequence
actccccaggaggaagtcc

SEQ ID NO: 10267 - DNA, 19 bp, Artificial sequence
  synthetic sequence
accgagaaagtgccacacc

SEQ ID NO: 10268 - DNA, 19 bp, Artificial sequence
  synthetic sequence
agaggaaggcccagcagag

SEQ ID NO: 10269 - DNA, 18 bp, Artificial sequence
  synthetic sequence
aaccggtaggccatgggt

SEQ ID NO: 10270 - DNA, 19 bp, Artificial sequence
  synthetic sequence
aaccggtggaccatcgact

SEQ ID NO: 10271 - DNA, 18 bp, Artificial sequence
  synthetic sequence
agccagtacctagtcccc

SEQ ID NO: 10272 - DNA, 18 bp, Artificial sequence
  synthetic sequence
aggacccggtccactcag

SEQ ID NO: 10273 - DNA, 20 bp, Artificial sequence
  synthetic sequence
aacccgtccctgaacctcct

SEQ ID NO: 10274 - DNA, 21 bp, Artificial sequence
  synthetic sequence
aacccccgtgcctacatgaac

SEQ ID NO: 10275 - DNA, 18 bp, Artificial sequence
  synthetic sequence
acagccgtccaagtggtc

SEQ ID NO: 10276 - DNA, 20 bp, Artificial sequence
  synthetic sequence
accttccgccggaacacgac

SEQ ID NO: 10277 - DNA, 18 bp, Artificial sequence
  synthetic sequence
accgacccgtcagtggaa

SEQ ID NO: 10278 - DNA, 18 bp, Artificial sequence
  synthetic sequence
agacgacttcggaggcgt

SEQ ID NO: 10279 - DNA, 18 bp, Artificial sequence
  synthetic sequence
aacgggtcaaggaaccgg

SEQ ID NO: 10280 - DNA, 20 bp, Artificial sequence
  synthetic sequence
acacacatgacgtggccgag

SEQ ID NO: 10281 - DNA, 18 bp, Artificial sequence
  synthetic sequence
acacgtcgccgacctacc

SEQ ID NO: 10282 - DNA, 18 bp, Artificial sequence
  synthetic sequence
acacaccgcgactagtgg

SEQ ID NO: 10283 - DNA, 20 bp, Artificial sequence
  synthetic sequence
aggctatcgagtcccaggac

SEQ ID NO: 10284 - DNA, 19 bp, Artificial sequence
  synthetic sequence
acagacgggtggagaacgg

SEQ ID NO: 10285 - DNA, 18 bp, Artificial sequence
  synthetic sequence
actccggcgtcagacgga

SEQ ID NO: 10286 - DNA, 21 bp, Artificial sequence
  synthetic sequence
aaggaccgaaggacctgaaac

SEQ ID NO: 10287 - DNA, 19 bp, Artificial sequence
  synthetic sequence
acgacctgtcgacctggag

SEQ ID NO: 10288 - DNA, 22 bp, Artificial sequence
  synthetic sequence
acaggtcccgactcaaagacta

SEQ ID NO: 10289 - DNA, 21 bp, Artificial sequence
  synthetic sequence
acgaggaagcggctctaagac

SEQ ID NO: 10290 - DNA, 18 bp, Artificial sequence
  synthetic sequence
accacggacactggcagt

SEQ ID NO: 10291 - DNA, 20 bp, Artificial sequence
  synthetic sequence
agaccccactagtagccccg

SEQ ID NO: 10292 - DNA, 20 bp, Artificial sequence
  synthetic sequence
acccggtcactcaactcgga

SEQ ID NO: 10293 - DNA, 19 bp, Artificial sequence
  synthetic sequence
accagtgaacccagggagg

SEQ ID NO: 10294 - DNA, 18 bp, Artificial sequence
  synthetic sequence
accccgtaccgtcaaacc

SEQ ID NO: 10295 - DNA, 18 bp, Artificial sequence
  synthetic sequence
agagcaaccgtagcaccc

SEQ ID NO: 10296 - DNA, 20 bp, Artificial sequence
  synthetic sequence
accgaggagccaccgaaagt

SEQ ID NO: 10297 - DNA, 18 bp, Artificial sequence
  synthetic sequence
agagaaaggcctcgagcg

SEQ ID NO: 10298 - DNA, 20 bp, Artificial sequence
  synthetic sequence
acagccccagcctctaaggg

SEQ ID NO: 10299 - DNA, 20 bp, Artificial sequence
  synthetic sequence
atcggtctaagtcaccgtct

SEQ ID NO: 10300 - DNA, 21 bp, Artificial sequence
  synthetic sequence
agacggtcacaccatgggtac

SEQ ID NO: 10301 - DNA, 23 bp, Artificial sequence
  synthetic sequence
accaagaccttcgaagcacaacg

SEQ ID NO: 10302 - DNA, 18 bp, Artificial sequence
  synthetic sequence
accgaaactgacgagccg

SEQ ID NO: 10303 - DNA, 21 bp, Artificial sequence
  synthetic sequence
aggagagaccctccgtatacg

SEQ ID NO: 10304 - DNA, 18 bp, Artificial sequence
  synthetic sequence
acacgaggtccagccgga

SEQ ID NO: 10305 - DNA, 20 bp, Artificial sequence
  synthetic sequence
aaccgtagacctaccaagtg

SEQ ID NO: 10306 - DNA, 20 bp, Artificial sequence
  synthetic sequence
aggcacttccaccaaacgac

SEQ ID NO: 10307 - DNA, 20 bp, Artificial sequence
  synthetic sequence
acgcgaacgccgggacacgt

SEQ ID NO: 10308 - DNA, 20 bp, Artificial sequence
  synthetic sequence
agaactccaaccggtcgcgc

SEQ ID NO: 10309 - DNA, 25 bp, Artificial sequence
  synthetic sequence
aggtccaaaagaaagggatcgagga

SEQ ID NO: 10310 - DNA, 20 bp, Artificial sequence
  synthetic sequence
agacgagaccacaccgtaac

SEQ ID NO: 10311 - DNA, 18 bp, Artificial sequence
  synthetic sequence
acaccgtgcaagaggtcc

SEQ ID NO: 10312 - DNA, 20 bp, Artificial sequence
  synthetic sequence
acccacggcatcaacctcta

SEQ ID NO: 10313 - DNA, 19 bp, Artificial sequence
  synthetic sequence
aacggggacatcgtggagg

SEQ ID NO: 10314 - DNA, 20 bp, Artificial sequence
  synthetic sequence
agccgaacaaggtgactgac

SEQ ID NO: 10315 - DNA, 20 bp, Artificial sequence
  synthetic sequence
aagggcgtcaagtatggctc

SEQ ID NO: 10316 - DNA, 20 bp, Artificial sequence
  synthetic sequence
agaggttgcggagaaaccag

SEQ ID NO: 10317 - DNA, 19 bp, Artificial sequence
  synthetic sequence
acgcgactcagtggaggag

SEQ ID NO: 10318 - DNA, 18 bp, Artificial sequence
  synthetic sequence
aacggaagagcgaagccg

SEQ ID NO: 10319 - DNA, 20 bp, Artificial sequence
  synthetic sequence
acgaatcgtcctcccgagtg

SEQ ID NO: 10320 - DNA, 22 bp, Artificial sequence
  synthetic sequence
agaactagcaacccgactaagg

SEQ ID NO: 10321 - DNA, 18 bp, Artificial sequence
  synthetic sequence
acagcccgtgacacaacc

SEQ ID NO: 10322 - DNA, 20 bp, Artificial sequence
  synthetic sequence
agaactcgtggtccggacac

SEQ ID NO: 10323 - DNA, 21 bp, Artificial sequence
  synthetic sequence
aggacccacccgaaaaacgac

SEQ ID NO: 10324 - DNA, 18 bp, Artificial sequence
  synthetic sequence
acgaccacaacgacaccg

SEQ ID NO: 10325 - DNA, 19 bp, Artificial sequence
  synthetic sequence
actccaccaggcagaggag

SEQ ID NO: 10326 - DNA, 18 bp, Artificial sequence
  synthetic sequence
acctgccacatgaccggg

SEQ ID NO: 10327 - DNA, 20 bp, Artificial sequence
  synthetic sequence
agagacggaggaagacggtc

SEQ ID NO: 10328 - DNA, 18 bp, Artificial sequence
  synthetic sequence
agcaggagaggccacgcg

SEQ ID NO: 10329 - DNA, 19 bp, Artificial sequence
  synthetic sequence
agacgaaccacgactcccc

SEQ ID NO: 10330 - DNA, 18 bp, Artificial sequence
  synthetic sequence
accccaccaagggactga

SEQ ID NO: 10331 - DNA, 20 bp, Artificial sequence
  synthetic sequence
agacgagaggcgacactgaa

SEQ ID NO: 10332 - DNA, 18 bp, Artificial sequence
  synthetic sequence
accagaccggtcgaccac

SEQ ID NO: 10333 - DNA, 19 bp, Artificial sequence
  synthetic sequence
acgaggagaggtacgaggg

SEQ ID NO: 10334 - DNA, 18 bp, Artificial sequence
  synthetic sequence
aacgagcaccgtcccaga

SEQ ID NO: 10335 - DNA, 18 bp, Artificial sequence
  synthetic sequence
aagcccggagaaccctag

SEQ ID NO: 10336 - DNA, 20 bp, Artificial sequence
  synthetic sequence
aggaagacacggtaagcgac

SEQ ID NO: 10337 - DNA, 20 bp, Artificial sequence
  synthetic sequence
accgaggccgaagagagaac

SEQ ID NO: 10338 - DNA, 18 bp, Artificial sequence
  synthetic sequence
aacgacgagaggggtagc

SEQ ID NO: 10339 - DNA, 20 bp, Artificial sequence
  synthetic sequence
accgaacaacaggagaccgg

SEQ ID NO: 10340 - DNA, 20 bp, Artificial sequence
  synthetic sequence
aggccggtcagacacttgac

SEQ ID NO: 10341 - DNA, 19 bp, Artificial sequence
  synthetic sequence
aaggacggcagtgaggagg

SEQ ID NO: 10342 - DNA, 18 bp, Artificial sequence
  synthetic sequence
aggtcatgccgcagccgg

SEQ ID NO: 10343 - DNA, 18 bp, Artificial sequence
  synthetic sequence
acacccgagacccaacga

SEQ ID NO: 10344 - DNA, 20 bp, Artificial sequence
  synthetic sequence
agacaggactccgcagtgtc

SEQ ID NO: 10345 - DNA, 18 bp, Artificial sequence
  synthetic sequence
acgagcttcaccgatcgc

SEQ ID NO: 10346 - DNA, 21 bp, Artificial sequence
  synthetic sequence
agaggagaaggagtggggacc

SEQ ID NO: 10347 - DNA, 19 bp, Artificial sequence
  synthetic sequence
atccgaacacgaaggacct

SEQ ID NO: 10348 - DNA, 18 bp, Artificial sequence
  synthetic sequence
acgtccctgactcccacc

SEQ ID NO: 10349 - DNA, 18 bp, Artificial sequence
  synthetic sequence
acggacacctacggccac

SEQ ID NO: 10350 - DNA, 18 bp, Artificial sequence
  synthetic sequence
acgccttgtgtacgaccc

SEQ ID NO: 10351 - DNA, 20 bp, Artificial sequence
  synthetic sequence
agcccgacagtctcaactat

SEQ ID NO: 10352 - DNA, 21 bp, Artificial sequence
  synthetic sequence
accagacgagagagacctgaa

SEQ ID NO: 10353 - DNA, 18 bp, Artificial sequence
  synthetic sequence
aagggtggcgaccctact

SEQ ID NO: 10354 - DNA, 20 bp, Artificial sequence
  synthetic sequence
agaggaggagtcccttcgtc

SEQ ID NO: 10355 - DNA, 20 bp, Artificial sequence
  synthetic sequence
acctccactgcgagaccgtg

SEQ ID NO: 10356 - DNA, 18 bp, Artificial sequence
  synthetic sequence
accgctccaacggacact

SEQ ID NO: 10357 - DNA, 18 bp, Artificial sequence
  synthetic sequence
agcccccaaacgacagtc

SEQ ID NO: 10358 - DNA, 18 bp, Artificial sequence
  synthetic sequence
aaggcacgcgcctacttc

SEQ ID NO: 10359 - DNA, 19 bp, Artificial sequence
  synthetic sequence
acactcgccctaaggctat

SEQ ID NO: 10360 - DNA, 18 bp, Artificial sequence
  synthetic sequence
agcggctcccgactagaa

SEQ ID NO: 10361 - DNA, 22 bp, Artificial sequence
  synthetic sequence
acccgttccactacaagggcat

SEQ ID NO: 10362 - DNA, 18 bp, Artificial sequence
  synthetic sequence
agaccgcgtaggcatagg

SEQ ID NO: 10363 - DNA, 20 bp, Artificial sequence
  synthetic sequence
agacccacccgtcagaagtc

SEQ ID NO: 10364 - DNA, 21 bp, Artificial sequence
  synthetic sequence
agaccccgcaagacacacagt

SEQ ID NO: 10365 - DNA, 19 bp, Artificial sequence
  synthetic sequence
acgaccgatgtgtccgagg

SEQ ID NO: 10366 - DNA, 18 bp, Artificial sequence
  synthetic sequence
aggaccgaagacgccgac

SEQ ID NO: 10367 - DNA, 21 bp, Artificial sequence
  synthetic sequence
acaacggtcgtgtcagaggag

SEQ ID NO: 10368 - DNA, 18 bp, Artificial sequence
  synthetic sequence
acggacgaacggcagcac

SEQ ID NO: 10369 - DNA, 20 bp, Artificial sequence
  synthetic sequence
aacgcacttgtcggaccgga

SEQ ID NO: 10370 - DNA, 21 bp, Artificial sequence
  synthetic sequence
acacatggcacctgacacctg

SEQ ID NO: 10371 - DNA, 21 bp, Artificial sequence
  synthetic sequence
acaggtgcatccctcagaccg

SEQ ID NO: 10372 - DNA, 22 bp, Artificial sequence
  synthetic sequence
aaggcaaagactgacgcacatc

SEQ ID NO: 10373 - DNA, 21 bp, Artificial sequence
  synthetic sequence
agtccagtagggacatctgcc

SEQ ID NO: 10374 - DNA, 18 bp, Artificial sequence
  synthetic sequence
accccaaccacggcctca

SEQ ID NO: 10375 - DNA, 20 bp, Artificial sequence
  synthetic sequence
acgaaccgcatctctccgtc

SEQ ID NO: 10376 - DNA, 20 bp, Artificial sequence
  synthetic sequence
aggcgtcgtcacggtacctg

SEQ ID NO: 10377 - DNA, 19 bp, Artificial sequence
  synthetic sequence
aggcctcactcggagctgc

SEQ ID NO: 10378 - DNA, 18 bp, Artificial sequence
  synthetic sequence
agctccaccaggggcgtc

SEQ ID NO: 10379 - DNA, 20 bp, Artificial sequence
  synthetic sequence
agcacgcctggactcggtaa

SEQ ID NO: 10380 - DNA, 18 bp, Artificial sequence
  synthetic sequence
acccctaagggcactggc

SEQ ID NO: 10381 - DNA, 18 bp, Artificial sequence
  synthetic sequence
agcggggacctccagggc

SEQ ID NO: 10382 - DNA, 20 bp, Artificial sequence
  synthetic sequence
actcctgcaactcccaccgt

SEQ ID NO: 10383 - DNA, 18 bp, Artificial sequence
  synthetic sequence
acgggtcggtagagcggc

SEQ ID NO: 10384 - DNA, 18 bp, Artificial sequence
  synthetic sequence
agcagaactccgccaagg

SEQ ID NO: 10385 - DNA, 20 bp, Artificial sequence
  synthetic sequence
acctccgaggtaggagtcgt

SEQ ID NO: 10386 - DNA, 22 bp, Artificial sequence
  synthetic sequence
acctcgacaacagttccatgta

SEQ ID NO: 10387 - DNA, 21 bp, Artificial sequence
  synthetic sequence
accccgaaggtgaactcgact

SEQ ID NO: 10388 - DNA, 21 bp, Artificial sequence
  synthetic sequence
accgctaccgtctcgacatgg

SEQ ID NO: 10389 - DNA, 19 bp, Artificial sequence
  synthetic sequence
acccccacacagtttacct

SEQ ID NO: 10390 - DNA, 18 bp, Artificial sequence
  synthetic sequence
agacccgaccgaagtcga

SEQ ID NO: 10391 - DNA, 18 bp, Artificial sequence
  synthetic sequence
acccgaagagcaacaggg

SEQ ID NO: 10392 - DNA, 20 bp, Artificial sequence
  synthetic sequence
agaggtgcgtcaggaggaac

SEQ ID NO: 10393 - DNA, 19 bp, Artificial sequence
  synthetic sequence
accgtacgacaaacacgtc

SEQ ID NO: 10394 - DNA, 18 bp, Artificial sequence
  synthetic sequence
aacgaccgacggtaccct

SEQ ID NO: 10395 - DNA, 18 bp, Artificial sequence
  synthetic sequence
aagcggagaccttaacgg

SEQ ID NO: 10396 - DNA, 18 bp, Artificial sequence
  synthetic sequence
acccctggtaaacaggca

SEQ ID NO: 10397 - DNA, 18 bp, Artificial sequence
  synthetic sequence
agaccaggaccgacaggt

SEQ ID NO: 10398 - DNA, 20 bp, Artificial sequence
  synthetic sequence
agacccgtcatcgaccgatg

SEQ ID NO: 10399 - DNA, 19 bp, Artificial sequence
  synthetic sequence
agaccaagtcctgtcccgg

SEQ ID NO: 10400 - DNA, 18 bp, Artificial sequence
  synthetic sequence
agagccggaagttgtgcg

SEQ ID NO: 10401 - DNA, 18 bp, Artificial sequence
  synthetic sequence
acgagccacctccacagg

SEQ ID NO: 10402 - DNA, 18 bp, Artificial sequence
  synthetic sequence
aacggtgacacgagtccg

SEQ ID NO: 10403 - DNA, 18 bp, Artificial sequence
  synthetic sequence
acccaagccccaacaacg

SEQ ID NO: 10404 - DNA, 21 bp, Artificial sequence
  synthetic sequence
aggacacgtcaggggattcgg

SEQ ID NO: 10405 - DNA, 21 bp, Artificial sequence
  synthetic sequence
agacgaggtgcaagaggaaca

SEQ ID NO: 10406 - DNA, 20 bp, Artificial sequence
  synthetic sequence
accaggtgcaccttcaggag

SEQ ID NO: 10407 - DNA, 20 bp, Artificial sequence
  synthetic sequence
aacgaccacttccgaaggag

SEQ ID NO: 10408 - DNA, 20 bp, Artificial sequence
  synthetic sequence
agacatgtccacacgcgact

SEQ ID NO: 10409 - DNA, 18 bp, Artificial sequence
  synthetic sequence
aacccccgtgaacagctg

SEQ ID NO: 10410 - DNA, 18 bp, Artificial sequence
  synthetic sequence
acacctggaccgctcgaa

SEQ ID NO: 10411 - DNA, 21 bp, Artificial sequence
  synthetic sequence
aaggtcgtgacagaccacgac

SEQ ID NO: 10412 - DNA, 20 bp, Artificial sequence
  synthetic sequence
aaccggtgccgatgtaaaac

SEQ ID NO: 10413 - DNA, 18 bp, Artificial sequence
  synthetic sequence
acagcaaggagccctgga

SEQ ID NO: 10414 - DNA, 18 bp, Artificial sequence
  synthetic sequence
agagcgccgtcggtaaga

SEQ ID NO: 10415 - DNA, 18 bp, Artificial sequence
  synthetic sequence
acgcccgaaccggacctt

SEQ ID NO: 10416 - DNA, 19 bp, Artificial sequence
  synthetic sequence
acaggtggtcggacacacg

SEQ ID NO: 10417 - DNA, 21 bp, Artificial sequence
  synthetic sequence
aggaagagagttgtcggaaga

SEQ ID NO: 10418 - DNA, 20 bp, Artificial sequence
  synthetic sequence
agacaggacgtccaccgaag

SEQ ID NO: 10419 - DNA, 18 bp, Artificial sequence
  synthetic sequence
aagggcagccgtcgtgta

SEQ ID NO: 10420 - DNA, 21 bp, Artificial sequence
  synthetic sequence
acggtagaagtgaccgagagt

SEQ ID NO: 10421 - DNA, 19 bp, Artificial sequence
  synthetic sequence
acacgagggagctgagacg

SEQ ID NO: 10422 - DNA, 20 bp, Artificial sequence
  synthetic sequence
aaccgtccacatctgcggtc

SEQ ID NO: 10423 - DNA, 18 bp, Artificial sequence
  synthetic sequence
agaccgtcgacgtcctac

SEQ ID NO: 10424 - DNA, 18 bp, Artificial sequence
  synthetic sequence
agggacttagggggaagg

SEQ ID NO: 10425 - DNA, 20 bp, Artificial sequence
  synthetic sequence
accgacgacaaggggaggtc

SEQ ID NO: 10426 - DNA, 18 bp, Artificial sequence
  synthetic sequence
aaccacgacaccaggacc

SEQ ID NO: 10427 - DNA, 21 bp, Artificial sequence
  synthetic sequence
acccagtctcagtcagaccga

SEQ ID NO: 10428 - DNA, 19 bp, Artificial sequence
  synthetic sequence
agggtggtccagggagggg

SEQ ID NO: 10429 - DNA, 20 bp, Artificial sequence
  synthetic sequence
accctactcctacaacccgg

SEQ ID NO: 10430 - DNA, 18 bp, Artificial sequence
  synthetic sequence
acgaggaagcccacccga

SEQ ID NO: 10431 - DNA, 20 bp, Artificial sequence
  synthetic sequence
acggtgaggacactcagagg

SEQ ID NO: 10432 - DNA, 18 bp, Artificial sequence
  synthetic sequence
accgacacgacgcctacg

SEQ ID NO: 10433 - DNA, 18 bp, Artificial sequence
  synthetic sequence
acgtccagggcaagagga

SEQ ID NO: 10434 - DNA, 22 bp, Artificial sequence
  synthetic sequence
acacaaagggttccggagggta

SEQ ID NO: 10435 - DNA, 19 bp, Artificial sequence
  synthetic sequence
accctgagtaaccgacgaa

SEQ ID NO: 10436 - DNA, 18 bp, Artificial sequence
  synthetic sequence
accaacagagggcagcgg

SEQ ID NO: 10437 - DNA, 21 bp, Artificial sequence
  synthetic sequence
acacggagagacagagcgaga

SEQ ID NO: 10438 - DNA, 19 bp, Artificial sequence
  synthetic sequence
accacagcgcctgccacag

SEQ ID NO: 10439 - DNA, 18 bp, Artificial sequence
  synthetic sequence
acgccgacatgtcccagg

SEQ ID NO: 10440 - DNA, 22 bp, Artificial sequence
  synthetic sequence
acgggggacaggtacctaatag

SEQ ID NO: 10441 - DNA, 22 bp, Artificial sequence
  synthetic sequence
aaggcccagggtcaacttaaac

SEQ ID NO: 10442 - DNA, 20 bp, Artificial sequence
  synthetic sequence
aggagggctcagaacacgaa

SEQ ID NO: 10443 - DNA, 18 bp, Artificial sequence
  synthetic sequence
agaccactgcgcgaacag

SEQ ID NO: 10444 - DNA, 21 bp, Artificial sequence
  synthetic sequence
agaggagggctggaacaggta

SEQ ID NO: 10445 - DNA, 18 bp, Artificial sequence
  synthetic sequence
accagggttactcgaccg

SEQ ID NO: 10446 - DNA, 20 bp, Artificial sequence
  synthetic sequence
acacagaagggtggccaagg

SEQ ID NO: 10447 - DNA, 18 bp, Artificial sequence
  synthetic sequence
accgaggacgccagagac

SEQ ID NO: 10448 - DNA, 19 bp, Artificial sequence
  synthetic sequence
aagggtcctgaccacctcg

SEQ ID NO: 10449 - DNA, 18 bp, Artificial sequence
  synthetic sequence
acagccgggtctagtggg

SEQ ID NO: 10450 - DNA, 20 bp, Artificial sequence
  synthetic sequence
agagcttctacgagcacctc

SEQ ID NO: 10451 - DNA, 18 bp, Artificial sequence
  synthetic sequence
agcccggaccgggttaaa

SEQ ID NO: 10452 - DNA, 18 bp, Artificial sequence
  synthetic sequence
accaactcgcaggggtcc

SEQ ID NO: 10453 - DNA, 18 bp, Artificial sequence
  synthetic sequence
aacggtgagtggtggtgc

SEQ ID NO: 10454 - DNA, 18 bp, Artificial sequence
  synthetic sequence
agcctgacgtgcaacagt

SEQ ID NO: 10455 - DNA, 18 bp, Artificial sequence
  synthetic sequence
acgaacaccacggtgacc

SEQ ID NO: 10456 - DNA, 18 bp, Artificial sequence
  synthetic sequence
aggggcaagacgtcgaag

SEQ ID NO: 10457 - DNA, 20 bp, Artificial sequence
  synthetic sequence
aggagggctctcatcgcgac

SEQ ID NO: 10458 - DNA, 18 bp, Artificial sequence
  synthetic sequence
accgacccacgactcgtc

SEQ ID NO: 10459 - DNA, 20 bp, Artificial sequence
  synthetic sequence
aggaaaacggtggcatggat

SEQ ID NO: 10460 - DNA, 20 bp, Artificial sequence
  synthetic sequence
aaccgtattgggacccgggc

SEQ ID NO: 10461 - DNA, 18 bp, Artificial sequence
  synthetic sequence
acggcgactcgctgcact

SEQ ID NO: 10462 - DNA, 21 bp, Artificial sequence
  synthetic sequence
aacgaccccaaacctccaagt

SEQ ID NO: 10463 - DNA, 18 bp, Artificial sequence
  synthetic sequence
acccaccagctaaggtcc

SEQ ID NO: 10464 - DNA, 18 bp, Artificial sequence
  synthetic sequence
acggctactaccggtccc

SEQ ID NO: 10465 - DNA, 18 bp, Artificial sequence
  synthetic sequence
accgacgcaccatctacc

SEQ ID NO: 10466 - DNA, 21 bp, Artificial sequence
  synthetic sequence
agacacaccgaagccctctag

SEQ ID NO: 10467 - DNA, 20 bp, Artificial sequence
  synthetic sequence
agacggaggcctcgtcgtag

SEQ ID NO: 10468 - DNA, 19 bp, Artificial sequence
  synthetic sequence
accaccatcgatacgcccc

SEQ ID NO: 10469 - DNA, 18 bp, Artificial sequence
  synthetic sequence
acgaaccactggaagccc

SEQ ID NO: 10470 - DNA, 18 bp, Artificial sequence
  synthetic sequence
acagctagtgggtcggct

SEQ ID NO: 10471 - DNA, 21 bp, Artificial sequence
  synthetic sequence
actggcctcgaagagaagcct

SEQ ID NO: 10472 - DNA, 18 bp, Artificial sequence
  synthetic sequence
aacgaggagtcgccaggt

SEQ ID NO: 10473 - DNA, 20 bp, Artificial sequence
  synthetic sequence
aggaacagtcaccggtggac

SEQ ID NO: 10474 - DNA, 22 bp, Artificial sequence
  synthetic sequence
accacaccggacgaaaagatcg

SEQ ID NO: 10475 - DNA, 22 bp, Artificial sequence
  synthetic sequence
acaccgtaacgtaaacctacgg

SEQ ID NO: 10476 - DNA, 19 bp, Artificial sequence
  synthetic sequence
atcgattcccacgaggcct

SEQ ID NO: 10477 - DNA, 18 bp, Artificial sequence
  synthetic sequence
acagctctacgggccccc

SEQ ID NO: 10478 - DNA, 21 bp, Artificial sequence
  synthetic sequence
agacggaagccataagacgag

SEQ ID NO: 10479 - DNA, 18 bp, Artificial sequence
  synthetic sequence
acggcgaatctcttccgg

SEQ ID NO: 10480 - DNA, 18 bp, Artificial sequence
  synthetic sequence
acacgtccgctacatggg

SEQ ID NO: 10481 - DNA, 20 bp, Artificial sequence
  synthetic sequence
agccagtcgaccatgagctc

SEQ ID NO: 10482 - DNA, 19 bp, Artificial sequence
  synthetic sequence
agaccgcagccaagactcc

SEQ ID NO: 10483 - DNA, 22 bp, Artificial sequence
  synthetic sequence
acaacgaacccaccaagtccca

SEQ ID NO: 10484 - DNA, 21 bp, Artificial sequence
  synthetic sequence
aggggccagtcacattccaag

SEQ ID NO: 10485 - DNA, 20 bp, Artificial sequence
  synthetic sequence
agaggtagaccctgggtgac

SEQ ID NO: 10486 - DNA, 18 bp, Artificial sequence
  synthetic sequence
acggatgccgtaagccga

SEQ ID NO: 10487 - DNA, 18 bp, Artificial sequence
  synthetic sequence
aaggcacgccaggtggag

SEQ ID NO: 10488 - DNA, 18 bp, Artificial sequence
  synthetic sequence
acccgctcggcaagtaca

SEQ ID NO: 10489 - DNA, 18 bp, Artificial sequence
  synthetic sequence
acccaccggtcctcacaa

SEQ ID NO: 10490 - DNA, 21 bp, Artificial sequence
  synthetic sequence
aggccgtagtagagcaaccgg

SEQ ID NO: 10491 - DNA, 20 bp, Artificial sequence
  synthetic sequence
accacctccagcaacctctg

SEQ ID NO: 10492 - DNA, 21 bp, Artificial sequence
  synthetic sequence
acgtcatcaggaaccaacacg

SEQ ID NO: 10493 - DNA, 21 bp, Artificial sequence
  synthetic sequence
aaccagtccttcccgcactac

SEQ ID NO: 10494 - DNA, 18 bp, Artificial sequence
  synthetic sequence
accacgccggtggtacga

SEQ ID NO: 10495 - DNA, 18 bp, Artificial sequence
  synthetic sequence
accagcaggcgggtaccc

SEQ ID NO: 10496 - DNA, 19 bp, Artificial sequence
  synthetic sequence
aaggagggacaggtccacg

SEQ ID NO: 10497 - DNA, 18 bp, Artificial sequence
  synthetic sequence
actgcctcagaccccagg

SEQ ID NO: 10498 - DNA, 18 bp, Artificial sequence
  synthetic sequence
acgggaacgtcggtcaac

SEQ ID NO: 10499 - DNA, 20 bp, Artificial sequence
  synthetic sequence
aaccgtccgagtcgtcaaac

SEQ ID NO: 10500 - DNA, 18 bp, Artificial sequence
  synthetic sequence
aacgcgaacctaccctcc

SEQ ID NO: 10501 - DNA, 18 bp, Artificial sequence
  synthetic sequence
accagctacggtatccgg

SEQ ID NO: 10502 - DNA, 22 bp, Artificial sequence
  synthetic sequence
agcaaccaactgtgcaacatgg

SEQ ID NO: 10503 - DNA, 18 bp, Artificial sequence
  synthetic sequence
accagggaaaggtgccag

SEQ ID NO: 10504 - DNA, 20 bp, Artificial sequence
  synthetic sequence
agctgccataaaacacggag

SEQ ID NO: 10505 - DNA, 21 bp, Artificial sequence
  synthetic sequence
accccagatacaactcccgtc

SEQ ID NO: 10506 - DNA, 19 bp, Artificial sequence
  synthetic sequence
aggacaggagtccgttccc

SEQ ID NO: 10507 - DNA, 20 bp, Artificial sequence
  synthetic sequence
agtcgtacccctcccacgtg

SEQ ID NO: 10508 - DNA, 20 bp, Artificial sequence
  synthetic sequence
aaggacaagtggcgacgggt

SEQ ID NO: 10509 - DNA, 19 bp, Artificial sequence
  synthetic sequence
aggagtcagactccgcacc

SEQ ID NO: 10510 - DNA, 18 bp, Artificial sequence
  synthetic sequence
acgagccacttcgagtcg

SEQ ID NO: 10511 - DNA, 18 bp, Artificial sequence
  synthetic sequence
acccagtacgggagcgaa

SEQ ID NO: 10512 - DNA, 19 bp, Artificial sequence
  synthetic sequence
aagcgggcagggacagtgc

SEQ ID NO: 10513 - DNA, 18 bp, Artificial sequence
  synthetic sequence
aacgcaaactggggccag

SEQ ID NO: 10514 - DNA, 20 bp, Artificial sequence
  synthetic sequence
aacccagaccctgctatggc

SEQ ID NO: 10515 - DNA, 19 bp, Artificial sequence
  synthetic sequence
aaccagtgacggttcgacg

SEQ ID NO: 10516 - DNA, 20 bp, Artificial sequence
  synthetic sequence
accggcctcaggtccctacc

SEQ ID NO: 10517 - DNA, 18 bp, Artificial sequence
  synthetic sequence
acccccgttagagtcagg

SEQ ID NO: 10518 - DNA, 20 bp, Artificial sequence
  synthetic sequence
aggggtcctcgactcggtag

SEQ ID NO: 10519 - DNA, 21 bp, Artificial sequence
  synthetic sequence
acccggaacgacgaagtgtac

SEQ ID NO: 10520 - DNA, 20 bp, Artificial sequence
  synthetic sequence
aacggagagtaacgttgcac

SEQ ID NO: 10521 - DNA, 22 bp, Artificial sequence
  synthetic sequence
acaagacaggatccggcgaaga

SEQ ID NO: 10522 - DNA, 20 bp, Artificial sequence
  synthetic sequence
acgacgggatccgacctgaa

SEQ ID NO: 10523 - DNA, 21 bp, Artificial sequence
  synthetic sequence
acggatcacactggtccagcg

SEQ ID NO: 10524 - DNA, 18 bp, Artificial sequence
  synthetic sequence
accgctacgtcagaagcc

SEQ ID NO: 10525 - DNA, 21 bp, Artificial sequence
  synthetic sequence
aacgggtccgtaggtggtatg

SEQ ID NO: 10526 - DNA, 18 bp, Artificial sequence
  synthetic sequence
aaggccactgtgggtggc

SEQ ID NO: 10527 - DNA, 19 bp, Artificial sequence
  synthetic sequence
agaggcacctcgacttcgt

SEQ ID NO: 10528 - DNA, 18 bp, Artificial sequence
  synthetic sequence
agacggtgtgtgacccga

SEQ ID NO: 10529 - DNA, 19 bp, Artificial sequence
  synthetic sequence
acacccctcaactcgtcct

SEQ ID NO: 10530 - DNA, 20 bp, Artificial sequence
  synthetic sequence
accagaaccatcccgacgtg

SEQ ID NO: 10531 - DNA, 19 bp, Artificial sequence
  synthetic sequence
acacaactgtgtcgcgacg

SEQ ID NO: 10532 - DNA, 18 bp, Artificial sequence
  synthetic sequence
agccctaacccgtgctca

SEQ ID NO: 10533 - DNA, 20 bp, Artificial sequence
  synthetic sequence
acccgtggagctgagactcc

SEQ ID NO: 10534 - DNA, 19 bp, Artificial sequence
  synthetic sequence
agacggccggccaacaagg

SEQ ID NO: 10535 - DNA, 20 bp, Artificial sequence
  synthetic sequence
acgagacccgtgtctacgac

SEQ ID NO: 10536 - DNA, 21 bp, Artificial sequence
  synthetic sequence
acgaagaaacagagtgcccag

SEQ ID NO: 10537 - DNA, 20 bp, Artificial sequence
  synthetic sequence
agagcctcagactctcccgg

SEQ ID NO: 10538 - DNA, 18 bp, Artificial sequence
  synthetic sequence
accccgaggtaaggagga

SEQ ID NO: 10539 - DNA, 21 bp, Artificial sequence
  synthetic sequence
atccagaaccacttcggggcc

SEQ ID NO: 10540 - DNA, 22 bp, Artificial sequence
  synthetic sequence
acgaaaagggtcacggagtacc

SEQ ID NO: 10541 - DNA, 19 bp, Artificial sequence
  synthetic sequence
agacgtgactccgtaggct

SEQ ID NO: 10542 - DNA, 18 bp, Artificial sequence
  synthetic sequence
acgccttacccaaggtcg

SEQ ID NO: 10543 - DNA, 18 bp, Artificial sequence
  synthetic sequence
aaccggtcacgaacgacg

SEQ ID NO: 10544 - DNA, 19 bp, Artificial sequence
  synthetic sequence
agaggtaaggaccggacac

SEQ ID NO: 10545 - DNA, 20 bp, Artificial sequence
  synthetic sequence
acggagaccaggaactaggt

SEQ ID NO: 10546 - DNA, 20 bp, Artificial sequence
  synthetic sequence
accaccgtggctaccactgc

SEQ ID NO: 10547 - DNA, 22 bp, Artificial sequence
  synthetic sequence
agcaacatgtgggtcagacggt

SEQ ID NO: 10548 - DNA, 21 bp, Artificial sequence
  synthetic sequence
acagggtgaaactccaggagc

SEQ ID NO: 10549 - DNA, 18 bp, Artificial sequence
  synthetic sequence
accagggcgtggcacgtc

SEQ ID NO: 10550 - DNA, 18 bp, Artificial sequence
  synthetic sequence
agcggaggttagacggcc

SEQ ID NO: 10551 - DNA, 22 bp, Artificial sequence
  synthetic sequence
aacccgactggactgtctaaag

SEQ ID NO: 10552 - DNA, 20 bp, Artificial sequence
  synthetic sequence
agcgcctacccaagctacct

SEQ ID NO: 10553 - DNA, 18 bp, Artificial sequence
  synthetic sequence
aacggcagccccaggaag

SEQ ID NO: 10554 - DNA, 18 bp, Artificial sequence
  synthetic sequence
acgctcgtcggacgtggg

SEQ ID NO: 10555 - DNA, 20 bp, Artificial sequence
  synthetic sequence
accatgaggagggcgacgaa

SEQ ID NO: 10556 - DNA, 20 bp, Artificial sequence
  synthetic sequence
acgagaacggaaacggcggc

SEQ ID NO: 10557 - DNA, 19 bp, Artificial sequence
  synthetic sequence
acgaacactccatcccgcc

SEQ ID NO: 10558 - DNA, 20 bp, Artificial sequence
  synthetic sequence
aggagggggtgagagtgtcc

SEQ ID NO: 10559 - DNA, 20 bp, Artificial sequence
  synthetic sequence
accgacaccctaccccatcc

SEQ ID NO: 10560 - DNA, 21 bp, Artificial sequence
  synthetic sequence
acgaagacgacgtcggagtcc

SEQ ID NO: 10561 - DNA, 18 bp, Artificial sequence
  synthetic sequence
accgggtaggaccagcta

SEQ ID NO: 10562 - DNA, 20 bp, Artificial sequence
  synthetic sequence
accacgtagaacggttcaaa

SEQ ID NO: 10563 - DNA, 22 bp, Artificial sequence
  synthetic sequence
acccaactgtcaggtcacaacg

SEQ ID NO: 10564 - DNA, 21 bp, Artificial sequence
  synthetic sequence
accacatccgcatctgcctcc

SEQ ID NO: 10565 - DNA, 19 bp, Artificial sequence
  synthetic sequence
aggagcatggacgtgagcg

SEQ ID NO: 10566 - DNA, 20 bp, Artificial sequence
  synthetic sequence
acggtcctctcggcagggac

SEQ ID NO: 10567 - DNA, 20 bp, Artificial sequence
  synthetic sequence
acctctcccaggactgaggg

SEQ ID NO: 10568 - DNA, 18 bp, Artificial sequence
  synthetic sequence
acaccgcgtctcggcgtc

SEQ ID NO: 10569 - DNA, 21 bp, Artificial sequence
  synthetic sequence
aaggaggaggcgtaggacgtt

SEQ ID NO: 10570 - DNA, 20 bp, Artificial sequence
  synthetic sequence
acgacagggtgacatgggga

SEQ ID NO: 10571 - DNA, 25 bp, Artificial sequence
  synthetic sequence
accgacaggacacagtgtacgataa

SEQ ID NO: 10572 - DNA, 20 bp, Artificial sequence
  synthetic sequence
aggagggggaacttcgacac

SEQ ID NO: 10573 - DNA, 18 bp, Artificial sequence
  synthetic sequence
aaggccgtcggacacgtc

SEQ ID NO: 10574 - DNA, 21 bp, Artificial sequence
  synthetic sequence
acagaagacgagggtgaaaga

SEQ ID NO: 10575 - DNA, 20 bp, Artificial sequence
  synthetic sequence
agagagaggacgccgtagca

SEQ ID NO: 10576 - DNA, 18 bp, Artificial sequence
  synthetic sequence
actggaacaggtccccga

SEQ ID NO: 10577 - DNA, 21 bp, Artificial sequence
  synthetic sequence
acccatgagcaggaggaacgt

SEQ ID NO: 10578 - DNA, 20 bp, Artificial sequence
  synthetic sequence
agccaaacgagaactacgtc

SEQ ID NO: 10579 - DNA, 21 bp, Artificial sequence
  synthetic sequence
acacagagagagagggaggac

SEQ ID NO: 10580 - DNA, 20 bp, Artificial sequence
  synthetic sequence
aggaagttcgagggggagaa

SEQ ID NO: 10581 - DNA, 18 bp, Artificial sequence
  synthetic sequence
acccgcacgacctgaaga

SEQ ID NO: 10582 - DNA, 18 bp, Artificial sequence
  synthetic sequence
acacccgcgacaggttcc

SEQ ID NO: 10583 - DNA, 19 bp, Artificial sequence
  synthetic sequence
agggacactccaagacccg

SEQ ID NO: 10584 - DNA, 20 bp, Artificial sequence
  synthetic sequence
acgccgacacccactacgtc

SEQ ID NO: 10585 - DNA, 18 bp, Artificial sequence
  synthetic sequence
agggagaggaagcagggt

SEQ ID NO: 10586 - DNA, 18 bp, Artificial sequence
  synthetic sequence
agacagggtccgacccag

SEQ ID NO: 10587 - DNA, 20 bp, Artificial sequence
  synthetic sequence
accaacggtgtagtggagac

SEQ ID NO: 10588 - DNA, 18 bp, Artificial sequence
  synthetic sequence
aggagccccatcgcccca

SEQ ID NO: 10589 - DNA, 21 bp, Artificial sequence
  synthetic sequence
acgtaaccctcggtgaaccgg

SEQ ID NO: 10590 - DNA, 18 bp, Artificial sequence
  synthetic sequence
agacaggtccacccgacg

SEQ ID NO: 10591 - DNA, 18 bp, Artificial sequence
  synthetic sequence
acacgtcccggagtaacg

SEQ ID NO: 10592 - DNA, 20 bp, Artificial sequence
  synthetic sequence
aacgggacgtgatggagaca

SEQ ID NO: 10593 - DNA, 18 bp, Artificial sequence
  synthetic sequence
agagggcacatccgcggt

SEQ ID NO: 10594 - DNA, 20 bp, Artificial sequence
  synthetic sequence
aactgaacccacctcgaacc

SEQ ID NO: 10595 - DNA, 18 bp, Artificial sequence
  synthetic sequence
aggaggacccagggaccg

SEQ ID NO: 10596 - DNA, 21 bp, Artificial sequence
  synthetic sequence
acggtcgtagaaccactggac

SEQ ID NO: 10597 - DNA, 20 bp, Artificial sequence
  synthetic sequence
aagaccggtacaacccccgt

SEQ ID NO: 10598 - DNA, 21 bp, Artificial sequence
  synthetic sequence
agacgagggtacttcgggtca

SEQ ID NO: 10599 - DNA, 21 bp, Artificial sequence
  synthetic sequence
aagtctcagacgcatgacccg

SEQ ID NO: 10600 - DNA, 21 bp, Artificial sequence
  synthetic sequence
atcgcaggcacattcaggagt

SEQ ID NO: 10601 - DNA, 21 bp, Artificial sequence
  synthetic sequence
aggatcctatggacagcggtg

SEQ ID NO: 10602 - DNA, 18 bp, Artificial sequence
  synthetic sequence
agccccctgacactcggc

SEQ ID NO: 10603 - DNA, 19 bp, Artificial sequence
  synthetic sequence
aacgacggtccacacgccc

SEQ ID NO: 10604 - DNA, 20 bp, Artificial sequence
  synthetic sequence
acgccagccctatgaggagt

SEQ ID NO: 10605 - DNA, 18 bp, Artificial sequence
  synthetic sequence
aaccggagaagacgacgg

SEQ ID NO: 10606 - DNA, 18 bp, Artificial sequence
  synthetic sequence
agggagcccgcaaggtaa

SEQ ID NO: 10607 - DNA, 18 bp, Artificial sequence
  synthetic sequence
acaggagacggtcgtacg

SEQ ID NO: 10608 - DNA, 18 bp, Artificial sequence
  synthetic sequence
aaccgggtaggagccacg

SEQ ID NO: 10609 - DNA, 22 bp, Artificial sequence
  synthetic sequence
acggaaaacggacatgagacca

SEQ ID NO: 10610 - DNA, 22 bp, Artificial sequence
  synthetic sequence
acccacacattaagaggtcgac

SEQ ID NO: 10611 - DNA, 19 bp, Artificial sequence
  synthetic sequence
agacggggtggagagagtc

SEQ ID NO: 10612 - DNA, 18 bp, Artificial sequence
  synthetic sequence
acacccgtagacaggacc

SEQ ID NO: 10613 - DNA, 20 bp, Artificial sequence
  synthetic sequence
acctatccgcgtccaacacc

SEQ ID NO: 10614 - DNA, 21 bp, Artificial sequence
  synthetic sequence
agaccgcctacctgtcaccct

SEQ ID NO: 10615 - DNA, 21 bp, Artificial sequence
  synthetic sequence
acggaactacaagtgtccgac

SEQ ID NO: 10616 - DNA, 20 bp, Artificial sequence
  synthetic sequence
aacgggaacaaggagacctc

SEQ ID NO: 10617 - DNA, 19 bp, Artificial sequence
  synthetic sequence
aaccagacttgcgacgacg

SEQ ID NO: 10618 - DNA, 20 bp, Artificial sequence
  synthetic sequence
aggccctcgaaggaagtgac

SEQ ID NO: 10619 - DNA, 19 bp, Artificial sequence
  synthetic sequence
agggcgtaggaagttgacc

SEQ ID NO: 10620 - DNA, 19 bp, Artificial sequence
  synthetic sequence
acgagtcaccagacacggg

SEQ ID NO: 10621 - DNA, 19 bp, Artificial sequence
  synthetic sequence
acacgagggcgaacatggg

SEQ ID NO: 10622 - DNA, 18 bp, Artificial sequence
  synthetic sequence
accaccccgtccagaaca

SEQ ID NO: 10623 - DNA, 18 bp, Artificial sequence
  synthetic sequence
acggccataaaccccaag

SEQ ID NO: 10624 - DNA, 22 bp, Artificial sequence
  synthetic sequence
agagtccgaggaacccatgtaa

SEQ ID NO: 10625 - DNA, 21 bp, Artificial sequence
  synthetic sequence
agacacccccagaactgtgcc

SEQ ID NO: 10626 - DNA, 18 bp, Artificial sequence
  synthetic sequence
aacggtaggctgtcgacc

SEQ ID NO: 10627 - DNA, 18 bp, Artificial sequence
  synthetic sequence
acggactgaaaccggagc

SEQ ID NO: 10628 - DNA, 20 bp, Artificial sequence
  synthetic sequence
agcaaaagacggctcgagac

SEQ ID NO: 10629 - DNA, 21 bp, Artificial sequence
  synthetic sequence
aggaaggcggaaaagaccctc

SEQ ID NO: 10630 - DNA, 18 bp, Artificial sequence
  synthetic sequence
acccaagtgtccaccgtc

SEQ ID NO: 10631 - DNA, 18 bp, Artificial sequence
  synthetic sequence
aaccccgactcgacgtca

SEQ ID NO: 10632 - DNA, 18 bp, Artificial sequence
  synthetic sequence
acggacagaacacagggc

SEQ ID NO: 10633 - DNA, 18 bp, Artificial sequence
  synthetic sequence
acgggaggctgcagaaca

SEQ ID NO: 10634 - DNA, 18 bp, Artificial sequence
  synthetic sequence
acgggaggctccagaaca

SEQ ID NO: 10635 - DNA, 18 bp, Artificial sequence
  synthetic sequence
aaccgctcctcccgggga

SEQ ID NO: 10636 - DNA, 21 bp, Artificial sequence
  synthetic sequence
acggagagtcgaagggcaacg

SEQ ID NO: 10637 - DNA, 18 bp, Artificial sequence
  synthetic sequence
aggcgtgtctgcaccaga

SEQ ID NO: 10638 - DNA, 19 bp, Artificial sequence
  synthetic sequence
aagcatcggtctcgaccgc

SEQ ID NO: 10639 - DNA, 20 bp, Artificial sequence
  synthetic sequence
accaccgacttcgagaaggc

SEQ ID NO: 10640 - DNA, 25 bp, Artificial sequence
  synthetic sequence
aggtacaacaaccaacaacctggtc

What is claimed is:

1. A method of preparing a plurality of sample-barcoded anchor-domain-flanked gene specific DNA fragments from a plurality of template RNA samples, the method comprising:
   contacting each template RNA sample from the plurality of template RNA samples with a set of reverse primers from a set of gene specific primer (GSP) pairs, wherein the reverse primers of the set of reverse primers are attached to a bead through a cleavable linker and comprise a gene specific domain, an anchor domain, and a sample barcode domain specific for the bead;
   cleaving the cleavable linker to release the set of gene specific primers so that gene specific primers hybridize to RNAs of the sample to produce a hybrid composition comprising RNA/anchored sample barcoded reverse primer hybrids;
   removing unbound reverse primers from the hybrid composition to produce a hybrid enriched composition;
   pooling the plurality of hybrid compositions comprising RNA/anchored sample barcoded reverse primer hybrids;
   reverse transcribing the hybrid enriched composition to produce a cDNA composition comprising cDNAs produced from the plurality of template RNA samples; and
   contacting the cDNA composition with forward primers of the set, wherein the forward primers comprise a gene specific domain and an anchor domain, under primer extension reaction conditions to produce the plurality of sample-barcoded anchor-domain-flanked gene specific DNA fragments from the plurality of template RNA samples.

2. The method according to claim 1, wherein the reverse primers further comprise a unique molecular identifier (UMI) domain.

3. The method according to claim 1, wherein the bead further comprises specific binding pair member.

4. The method according to claim 3, wherein the specific binding pair member specifically binds to a cell surface marker.

5. The method according to claim 1, wherein the template RNA sample from the plurality of template RNA samples is obtained from a single cell.

6. The method according to claim 5, wherein the method comprises obtaining the template RNA sample by isolating the single cell and then lysing the isolated single cell to produce the template RNA sample.

7. The method according to claim 6, wherein the cell is isolated and lysed in a well or droplet.

8. The method according to claim 1, wherein the method comprises employing a calibration ribonucleic acid composition.

9. The method according to claim 1, wherein the method further comprises removing non-extended forward primers from the plurality of sample-barcoded anchor-domain-flanked gene specific DNA fragments.

10. The method according to claim 1, wherein the flanking anchor domains comprise a universal priming site and the method further comprises amplifying the plurality of sample-barcoded anchor-domain-flanked gene specific DNA fragments comprising the anchor domains with universal forward and reverse primers having sequences complementary to the universal priming sites under amplification conditions sufficient to produce a barcoded amplicon composition comprising multiple product amplicons.

11. The method of claim 1, wherein the set of GSP pairs comprises from 10 to 25,000 GSP pairs.

12. The method of claim 1, wherein the set of GSP pairs comprises from 1,000 to 10,000 GSP pairs.

* * * * *